US008658413B2

(12) United States Patent
Bosak et al.

(10) Patent No.: US 8,658,413 B2
(45) Date of Patent: *Feb. 25, 2014

(54) MUTANT HPGG MOTIF AND HDASH MOTIF DELTA-5 DESATURASES AND THEIR USE IN MAKING POLYUNSATURATED FATTY ACIDS

(75) Inventors: Melissa D. Bosak, Mount Royal, NJ (US); Michael W. Bostick, Wilmington, DE (US); Hongxian He, Wilmington, DE (US); Seung-Pyo Hong, Hockessin, DE (US); Dana M. Walters Pollak, West Chester, PA (US); Pamela L. Sharpe, Wilmington, DE (US); Yehong Jamie Wang, Newark, DE (US); Zhixiong Xue, Chadds Ford, PA (US); Narendra S. Yadav, Wilmington, DE (US); Hongxiang Zhang, Chadds Ford, PA (US); Quinn Qun Zhu, West Chester, PA (US)

(73) Assignee: E I du Pont de Nemours and Company, Wilmington, DE (US)

( * ) Notice: Subject to any disclaimer, the term of this patent is extended or adjusted under 35 U.S.C. 154(b) by 90 days.

This patent is subject to a terminal disclaimer.

(21) Appl. No.: 13/218,673

(22) Filed: Aug. 26, 2011

(65) Prior Publication Data

US 2012/0052549 A1    Mar. 1, 2012

Related U.S. Application Data

(60) Provisional application No. 61/377,248, filed on Aug. 26, 2010, provisional application No. 61/428,277, filed on Dec. 30, 2010.

(51) Int. Cl.
*C12N 1/20* (2006.01)
*C12N 9/00* (2006.01)
*C07H 21/04* (2006.01)

(52) U.S. Cl.
USPC ............... 435/252.3; 435/183; 536/23.1

(58) Field of Classification Search
USPC ............... 435/252.3, 183; 536/23.1
See application file for complete search history.

(56) References Cited

U.S. PATENT DOCUMENTS

| 7,678,560 B2 | 3/2010 | Damude et al. |
| 7,842,852 B2 | 11/2010 | Cirpus et al. |
| 7,943,365 B2 | 5/2011 | Damude et al. |
| 2010/0075386 A1 | 3/2010 | Zhu et al. |
| 2010/0317072 A1 | 12/2010 | Hong et al. |

FOREIGN PATENT DOCUMENTS

| WO | 2006008099 A2 | 1/2006 |
| WO | 2008073367 A1 | 6/2008 |
| WO | 2009046231 A1 | 4/2009 |
| WO | 2010033753 A2 | 3/2010 |

OTHER PUBLICATIONS

Related U.S. Appl. No. 13/218,591 (Michael D. Bostik et al.) Filed Aug. 26, 2011.
Related U.S. Appl. No. 13/218,708(Seung Pyo Hong et al.) Filed Aug. 26, 2011.
International Search Report, PCT International Application No. PCT/US2011/049403, Mailed Dec. 9, 2011.
Related International Application, PCT International Application No. PCT/US2011/049361 (Michael W. Bostick et al.) Filed Aug. 26, 2011.
Related International Application, PCT International Application No. PCT/US2011/049384 (Seung-Pyo Hong et al.) Filed Aug. 26, 2011.

*Primary Examiner* — Karen Cochrane Carlson

(57) ABSTRACT

Mutant delta-5 desaturases, having the ability to convert dihomo-gamma-linolenic acid [DGLA; 20:3 omega-6] to arachidonic acid [ARA; 20:4 omega-6] and/or eicosatetraenoic acid [ETA; 20:4 omega-3] to eicosapentaenoic acid [EPA; 20:5 omega-3] and possessing at least one mutation within the HPGG (SEQ ID NO:7) motif of the cytochome $b_5$-like domain and at least one mutation within the HDASH (SEQ ID NO:8) motif are disclosed. Isolated nucleic acid fragments and recombinant constructs comprising such fragments encoding delta-5 desaturases, along with a method of making long chain polyunsaturated fatty acids ["PUFAs"], are also disclosed.

11 Claims, 17 Drawing Sheets

```
                        10                  20                  30                  40                  50                  60                  70
                        |                   |                   |                   |                   |                   |                   |
EgD5 (SEQ ID NO. 20)    ATGGCTCTCAGTCTTACCACAGAACAGCTGTTAGAACGCCCTGATTTGGTTGCGATTGATGGCATCCTCT
EgD5R (SEQ ID NO. 24)   ATGGCTCTCAGTCTTACCACAGAACAGCTGTTAGAACGCCCTGATTTGGTTGCGATTGATGGCATCCTCT 80                  90                  100                 110                 120                 130                 140
                        |                   |                   |                   |                   |                   |                   |
EgD5 (SEQ ID NO. 20)    ACGACCTTGAAGGGCTTGCCAAAGTTCATCCAGGAGGAGATTTGATTCGCTTCTCGCTTCTGGTGCCTCTGATGC
EgD5R (SEQ ID NO. 24)   ACGACCTTGAAGGGCTTGCCAAAGTTCATCCAGGAGGAGATTTGATTCGCTTCTCGCTTCTGGTGCCTCTGATGC 150                 160                 170                 180                 190                 200                 210
                        |                   |                   |                   |                   |                   |                   |
EgD5 (SEQ ID NO. 20)    CTCCCCTCTCTTTTATTCAATGCATCCATACGTCAAACCGGAGAATTCCAAATTGCTTCAACAGTTCGTC
EgD5R (SEQ ID NO. 24)   CTCCCCTCTCTTTTATTCAATGCATCCATACGTCAAACCGGAGAATTCCAAATTGCTTCAACAGTTCGTC 220                 230                 240                 250                 260                 270                 280
                        |                   |                   |                   |                   |                   |                   |
EgD5 (SEQ ID NO. 20)    CGAGGGAAGCATGACCGCACCTCGAAGGACATTGTCTACACGTATGATTCTCCCTTCGCACAAGACGTTA
EgD5R (SEQ ID NO. 24)   CGAGGGAAGCATGACCGCACCTCGAAGGACATTGTCTACACGTATGATTCTCCCTTCGCACAAGACGTTA 290                 300                 310                 320                 330                 340                 350
                        |                   |                   |                   |                   |                   |                   |
EgD5 (SEQ ID NO. 20)    AGCGGACAATGCGCGAGGTGATGAAAGGGAGGAACTGGTACGCAACCCCTGGCTTCTGGCTGCGCACCGT
EgD5R (SEQ ID NO. 24)   AGCGGACAATGCGCGAGGTGATGAAAGGGAGGAACTGGTACGCAACCCCTGGCTTCTGGCTGCGCACCGT
```

FIG. 3A

```
                      360              370              380              390              400              410              420
                       |                |                |                |                |                |                |
EgD5  (SEQ ID NO. 20)  TGGGATCATCGCCGTGACGGCCTTTTGCGAGTGGCACTGGGCTACCACGGGGATGGTGCTGTGGGGCCTG
EgD5R (SEQ ID NO. 24)  TGGGATCATCGCCGTGACGGCCTTTTGCGAGTGGCACTGGGCTACCACGGGGATGGTGCTGTGGGGCCTG 430              440              450              460              470              480              490
                       |                |                |                |                |                |                |
EgD5  (SEQ ID NO. 20)  TTGACTGGATTCATGCACATGCAGATGGCTTATCCATCCAGCATGATGCGTCCCACGGGGCCATCAGCA
EgD5R (SEQ ID NO. 24)  TTGACTGGATTCATGCACATGCAGATGGCTTATCCATCCAGCATGATGCGTCCCACGGGGCCATCAGCA 500              510              520              530              540              550              560
                       |                |                |                |                |                |                |
EgD5  (SEQ ID NO. 20)  AGAAGCCCTTGGGTCAACGGCCCCTCTTCGCTTACGGACGTCATCGGATCGTCCCGGTGGATTTGGCT
EgD5R (SEQ ID NO. 24)  AGAAGCCCTTGGGTCAACGGCCCCTCTTCGCTTACGGACGTCATCGGATCGTCCCGGTGGATTTGGCT 570              580              590              600              610              620              630
                       |                |                |                |                |                |                |
EgD5  (SEQ ID NO. 20)  GCAGTCGCACATCATGCGGCACCACACTACACCAACCAGCACGGCCTCGACCTGGATGCGGAGTCGGCA
EgD5R (SEQ ID NO. 24)  GCAGTCGCACATCATGCGGCACCACACTACACCAACCAGCACGGCCTCGACCTGGATGCGGAGTCGGCA 640              650              660              670              680              690              700
                       |                |                |                |                |                |                |
EgD5  (SEQ ID NO. 20)  GAGCCGGTTCCTGGTGTTCCACAACTACCCCGCCCGCCGAAAGTGGTTCCACCGCCTTCCAAG
EgD5R (SEQ ID NO. 24)  GAGCCGGTTCCTGGTGTTCCACAAGTACCCCGCCCGCCGAAAGTGGTTCCACCGCCTTCCAAG
```

FIG. 3B

```
EgD5  (SEQ ID NO. 20)   CTTGGTACACATTGTGCTGGGGGCATACGGGGTATCGCTGGTGTACAACCCGGTCTACATTTTCCG
EgD5R (SEQ ID NO. 24)   CTTGGTACACATTGTGCTGGGGGCATACGGGGTATCGCTGGTGTACAACCCGGTCTACATTTTCCG
                        710        720        730        740        750        760        770

EgD5  (SEQ ID NO. 20)   GATGCAGCACAATGACACCATCCCAGAGTCTGTCACGGCCATGCGGGAGAATGGCTTTCTGCGGCGCTAC
EgD5R (SEQ ID NO. 24)   GATGCAGCACAATGACACCATCCCAGAGTCTGTCACGGCCATGCGGGAGAAATGGCTTTCTGCGGCGCTAC
                        780        790        800        810        820        830        840

EgD5  (SEQ ID NO. 20)   CGCACACACTTGCATTCGTGATGCGAGCTTTCATTCTTCCGGACCGCATTCTTGCCCTGGTACCTCACTG
EgD5R (SEQ ID NO. 24)   CGCACACACTTGCATTCGTGATGCGAGCTTTCATTCTTCCGGACCGCATTCTTGCCCTGGTACCTCACTG
                        850        860        870        880        890        900        910

EgD5  (SEQ ID NO. 20)   GGACCTCATTGCTGATCACCATTCCTCTGGTGCCCACTGGCAACTGGTGCCTTCTTGACGTTCTTCTTCAT
EgD5R (SEQ ID NO. 24)   GGACCTCATTGCTGATCACCATTCCTCTGGTGCCCACTGGCAACTGGTGCCTTCTTGACGTTCTTCTTCAT
                        920        930        940        950        960        970        980

EgD5  (SEQ ID NO. 20)   TTTGTCCCACAATTTTGATGGCTCCGAACGGATCCCGACAAGAACTGCAAGGTTAAGAGTCTGAGAAG
EgD5R (SEQ ID NO. 24)   TTTGTCCCACAATTTTGATGGCTCCGAACGGATCCCGACAAGAACTGCAAGGTTAAGAGATCTGAGAAG
                        990       1000       1010       1020       1030       1040       1050
```

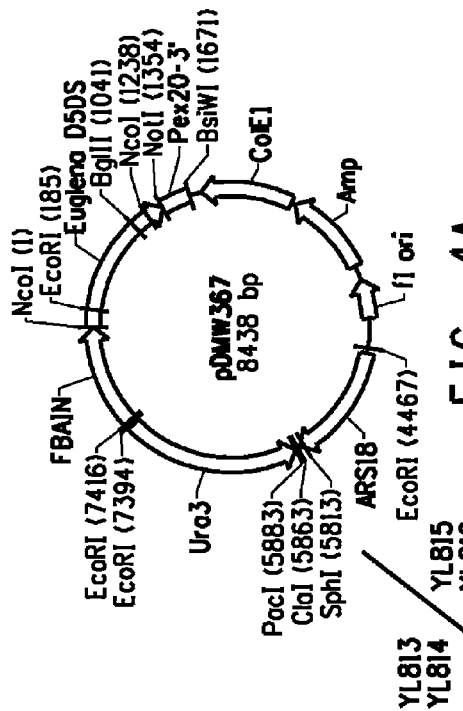
FIG. 4A FIG. 4B FIG. 4C

FIG. 5

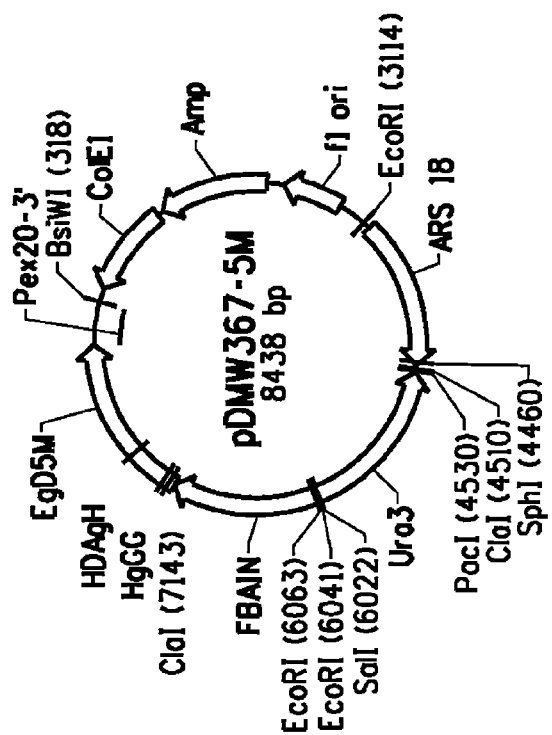
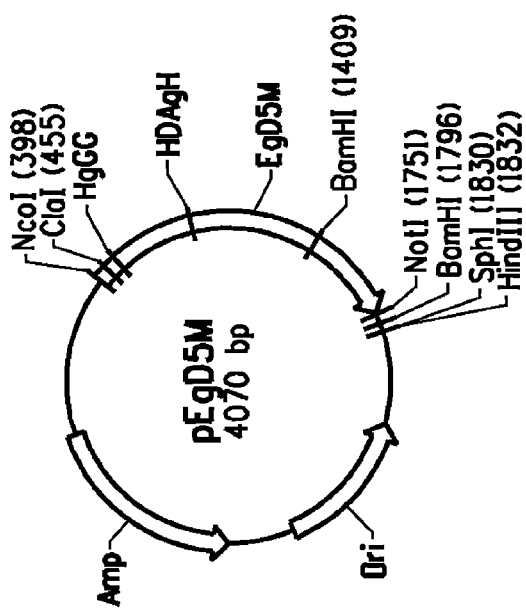
FIG. 6B
FIG. 6A

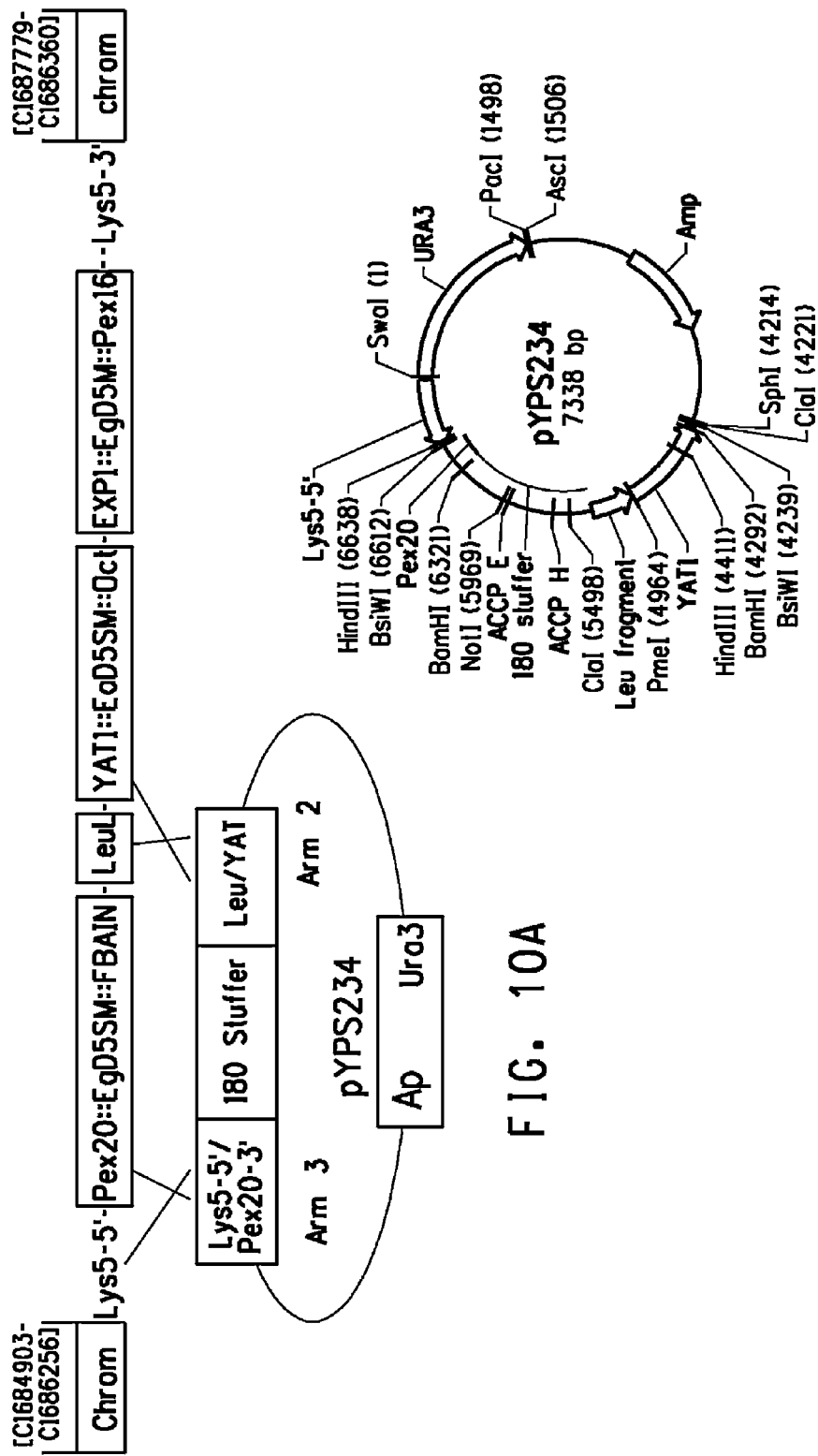

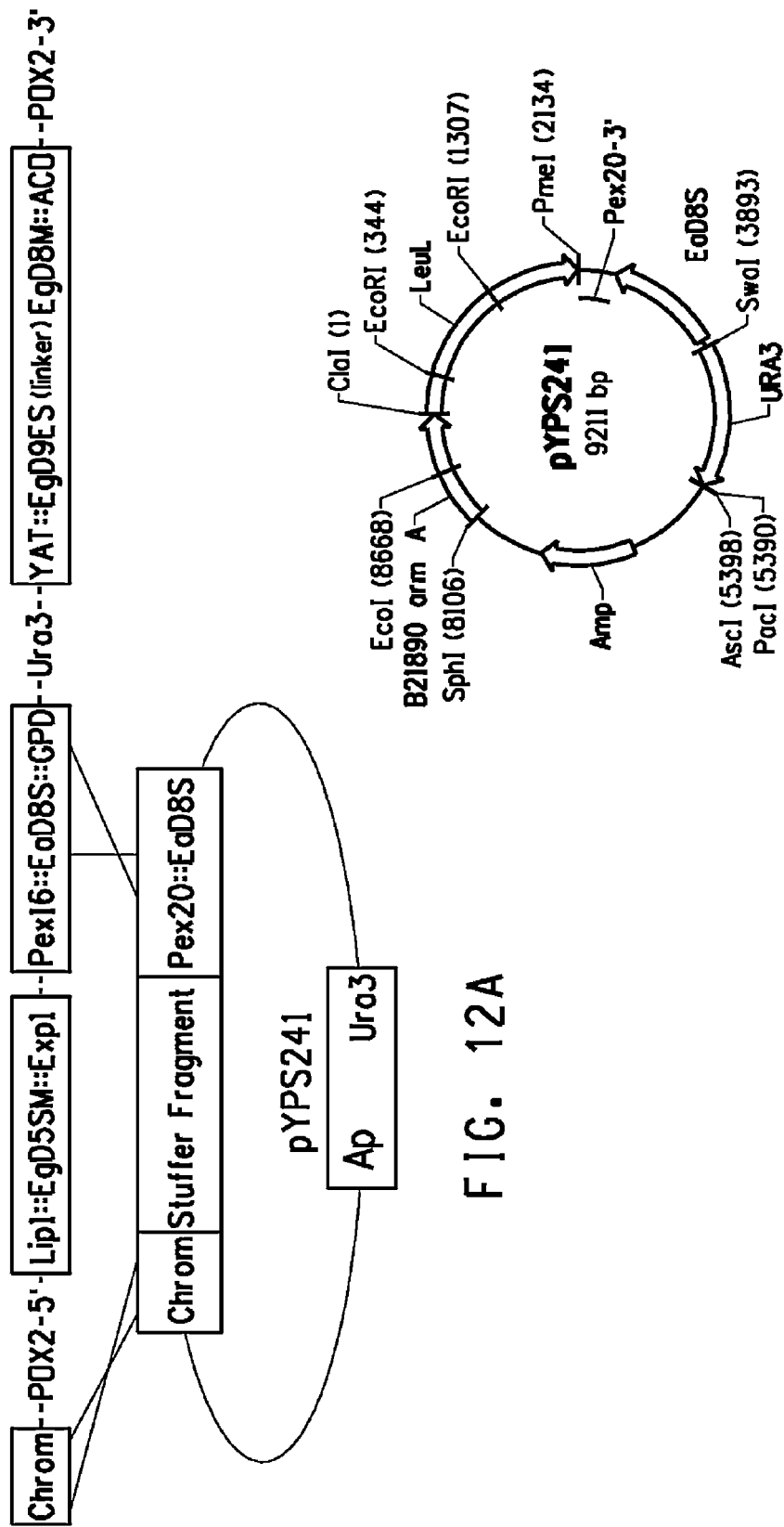

US 8,658,413 B2

MUTANT HPGG MOTIF AND HDASH MOTIF DELTA-5 DESATURASES AND THEIR USE IN MAKING POLYUNSATURATED FATTY ACIDS

This application claims the benefit of U.S. Provisional Application No. 61/377,248, filed Aug. 26, 2010, and U.S. Provisional Application No. 61/428,277, filed Dec. 30, 2010, the disclosures of which are hereby incorporated by reference in their entireties.

FIELD OF THE INVENTION

This invention is in the field of biotechnology. More specifically, this invention pertains to making nucleic acid fragments encoding mutant delta-5 fatty acid desaturases (wherein at least one mutation occurs within the HPGG [SEQ ID NO:7] motif of the cytochrome $b_5$-like domain and at least one mutation occurs within the HDASH [SEQ ID NO:8] motif).

BACKGROUND OF THE INVENTION

A variety of different hosts including plants, algae, fungi, stramenopiles and yeast are being investigated as means for commercial polyunsaturated fatty acid ["PUFA"] production. Genetic engineering has demonstrated that the natural abilities of some hosts (even those natively limited to linoleic acid [LA; 18:2 omega-6] and α-linolenic acid [ALA; 18:3 omega-3] fatty acid production) can be substantially altered to result in high-level production of various long-chain omega-3/omega-6 PUFAs. Whether this is the result of natural abilities or recombinant technology, production of arachidonic acid [ARA; 20:4 omega-6], eicosapentaenoic acid [EPA; 20:5 omega-3] and docosahexaenoic acid [DHA; 22:6 omega-3] may all require expression of a delta-5 desaturase gene.

Thus, the instant invention concerns new delta-5 desaturases having high activity that are well suited for integration into PUFA biosynthetic pathways in commercially useful host cells.

SUMMARY OF THE INVENTION

In a first embodiment, the invention concerns a mutant polypeptide having delta-5 desaturase activity comprising:
 (a) an amino acid motif as set forth in SEQ ID NO:34 [ HxGx], wherein SEQ ID NO:34 [ HxGx] is not identical to SEQ ID NO:7 [ HPGG]; and,
 (b) an amino acid motif as set forth in SEQ ID NO:1 [ HxxxH], wherein SEQ ID NO:1 [ HxxxH] is not identical to SEQ ID NO:8 [ HDASH].

In a second embodiment, the amino acid motif of (a) is selected from the group consisting of: SEQ ID NO:9 [ HgGG], SEQ ID NO:10 [ HhGG], SEQ ID NO:11 [ HPGs], SEQ ID NO:12 [ HcGG], SEQ ID NO:13 [ HwGG] and SEQ ID NO:14 [ HaGG]; and, the amino acid motif of (b) is selected from the group consisting of: SEQ ID NO:15 [ HDsSH], SEQ ID NO:16 [ HDsSH], SEQ ID NO:17 [ HDAaH], SEQ ID NO:18 [ HDAgH] and SEQ ID NO:19 [ HeASH].

In a third embodiment, the mutant polypeptide has at least 90% sequence identity based on a BLASTP method of alignment when compared to a polypeptide having a sequence selected from the group consisting of: SEQ ID NO:21, SEQ ID NO:25 and SEQ ID NO:29.

In a fourth embodiment, the amino acid sequence of the mutant polypeptide is selected from the group consisting of: SEQ ID NO:139 [EgD5R*-34g157g], SEQ ID NO:141 [EgD5R*-34g158a], SEQ ID NO:143 [EgD5R*-34g158g], SEQ ID NO:145 [EgD5R*-34h158a], SEQ ID NO:147 [EgD5R*-34h158g], SEQ ID NO:149 [EgD5R*-36s158a], SEQ ID NO:151 [EgD5R*-36s158g], SEQ ID NO:153 [EgD5M, codon-optimized EgD5R*-34g158g], SEQ ID NO:157 [EgD5M1, codon-optimized EgD5R*-34g158g347s], SEQ ID NO:181 [EgD5S-36s156e], SEQ ID NO:183 [EgD5S-36s157g], SEQ ID NO:185 [EgD5S-36s158a], SEQ ID NO:187 [EgD5S-36s158g], SEQ ID NO:213 [EaD5S-35a158g], SEQ ID NO:215 [EaD5S-35a158s], SEQ ID NO:217 [EaD5S-35a159g], SEQ ID NO:255 [EgD5R-34g158g], SEQ ID NO:260 [EgD5R-34g158a], SEQ ID NO:271 [EaD5-35g159g], and SEQ ID NO:276 [EaD5-35g159a].

In a fifth embodiment, the mutant polypeptide has a dihomo-γ-linolenic acid to arachidonic acid conversion efficiency that is at least 64% of the dihomo-γ-linolenic acid to arachidonic acid conversion efficiency of the parent polypeptide, said parent polypeptide comprising an amino acid motif identical to SEQ ID NO:7 [HPGG] and an amino acid motif identical to SEQ ID NO:8 [HDASH].

In a sixth embodiment, the invention concerns an isolated nucleic acid molecule encoding any of the mutant polypeptides described above. Preferably, the isolated nucleic acid molecule has a nucleotide sequence selected from the group consisting of: SEQ ID NO:138 [EgD5R*-34g157g], SEQ ID NO:140 [EgD5R*-34g158a], SEQ ID NO:142 [EgD5R*-34g158g], SEQ ID NO:144 [EgD5R*-34h158a], SEQ ID NO:146 [EgD5R*-34h158g], SEQ ID NO:148 [EgD5R*-36s158a], SEQ ID NO:150 [EgD5R*-36s158g], SEQ ID NO:152 [EgD5M, codon-optimized EgD5R*-34g158g], SEQ ID NO:156 [EgD5M1, codon-optimized EgD5R*-34g158g347s], SEQ ID NO:180 [EgD5S-36s156e], SEQ ID NO:182 [EgD5S-36s157g], SEQ ID NO:184 [EgD5S-36s158a], SEQ ID NO:186 [EgD5S-36s158g], SEQ ID NO:212 [EaD5S-35a158g], SEQ ID NO:214 [EaD5S-35a158s], SEQ ID NO:216 [EaD5S-35a159g], SEQ ID NO:254 [EgD5R-34g158g], SEQ ID NO:259 [EgD5R-34g158a], SEQ ID NO:270 [EaD5-35g159g], and SEQ ID NO:275 [EaD5-35g159a].

In a seventh embodiment, the invention concerns a transformed host cell expressing any of the mutant polypeptides. Preferably, the transformed host cell is selected from the group consisting of; microbes, most preferably oleaginous yeast; and plants, most preferably, oilseed plants.

In an eighth embodiment, the transformed host cell produces a polyunsaturated fatty acid selected from the group consisting of omega-6 fatty acids and omega-3 fatty acids.

BIOLOGICAL DEPOSITS

The following biological material has been deposited with the American Type Culture Collection (ATCC), 10801 University Boulevard, Manassas, Va. 20110-2209, and bears the following designation, accession number and date of deposit.

| Biological Material | Accession No. | Date of Deposit |
| --- | --- | --- |
| Yarrowia lipolytica Y8412 | ATCC PTA-10026 | May 14, 2009 |

The biological material listed above was deposited under the terms of the Budapest Treaty on the International Recognition of the Deposit of Microorganisms for the Purposes of Patent Procedure. The listed deposit will be maintained in the indicated international depository for at least 30 years and will be made available to the public upon the grant of a patent disclosing it. The availability of a deposit does not constitute a license to practice the subject invention in derogation of patent rights granted by government action.

Yarrowia lipolytica Y9502 was derived from Yarrowia lipolytica Y8412, according to the methodology described in U.S. Pat. Appl. Pub. No. 2010-0317072-A1.

BRIEF DESCRIPTION OF THE DRAWINGS AND SEQUENCE LISTINGS

Figure 3D:
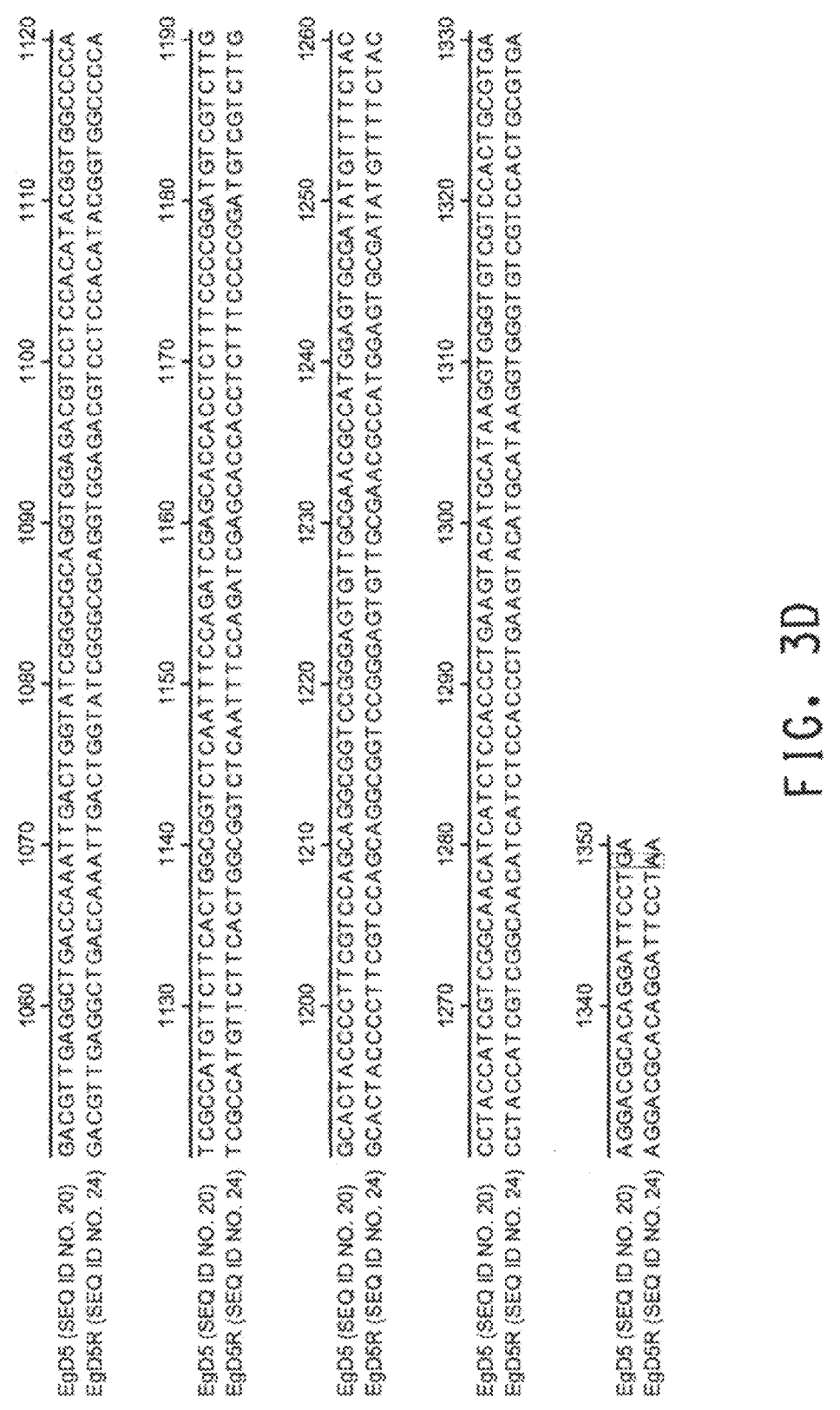

FIGS. 3A, 3B, 3C and 3D show an alignment of the DNA sequences of the wildtype delta-5 desaturase gene from *Euglena gracilis* (i.e., EgD5 [SEQ ID NO:20]) with a variant wildtype *E. gracilis* delta-5 desaturase gene that contains a S347R mutation (i.e., EgD5R [SEQ ID NO:24]).

FIGS. 4A, 4B and 4C illustrate the construction of plasmid pDMW367-M4.

FIG. 5 shows a sequence alignment of the 5' portion of the variant wildtype delta-5 desaturase gene from *E. gracilis* (i.e., EgD5R [SEQ ID NO:24]) with the first 204 bp of the synthetic mutant delta-5 desaturase, derived from *E. gracilis* and codon-optimized for expression in *Yarrowia lipolytica*, and comprising HgGG [SEQ ID NO:9] and HDAgH [SEQ ID NO:18] motifs (i.e., EgD5M [SEQ ID NO:152]).

FIG. 6 provides plasmid maps for the following: (A) pEgD5M and (B) pDMW367-5M.

Figure 7:
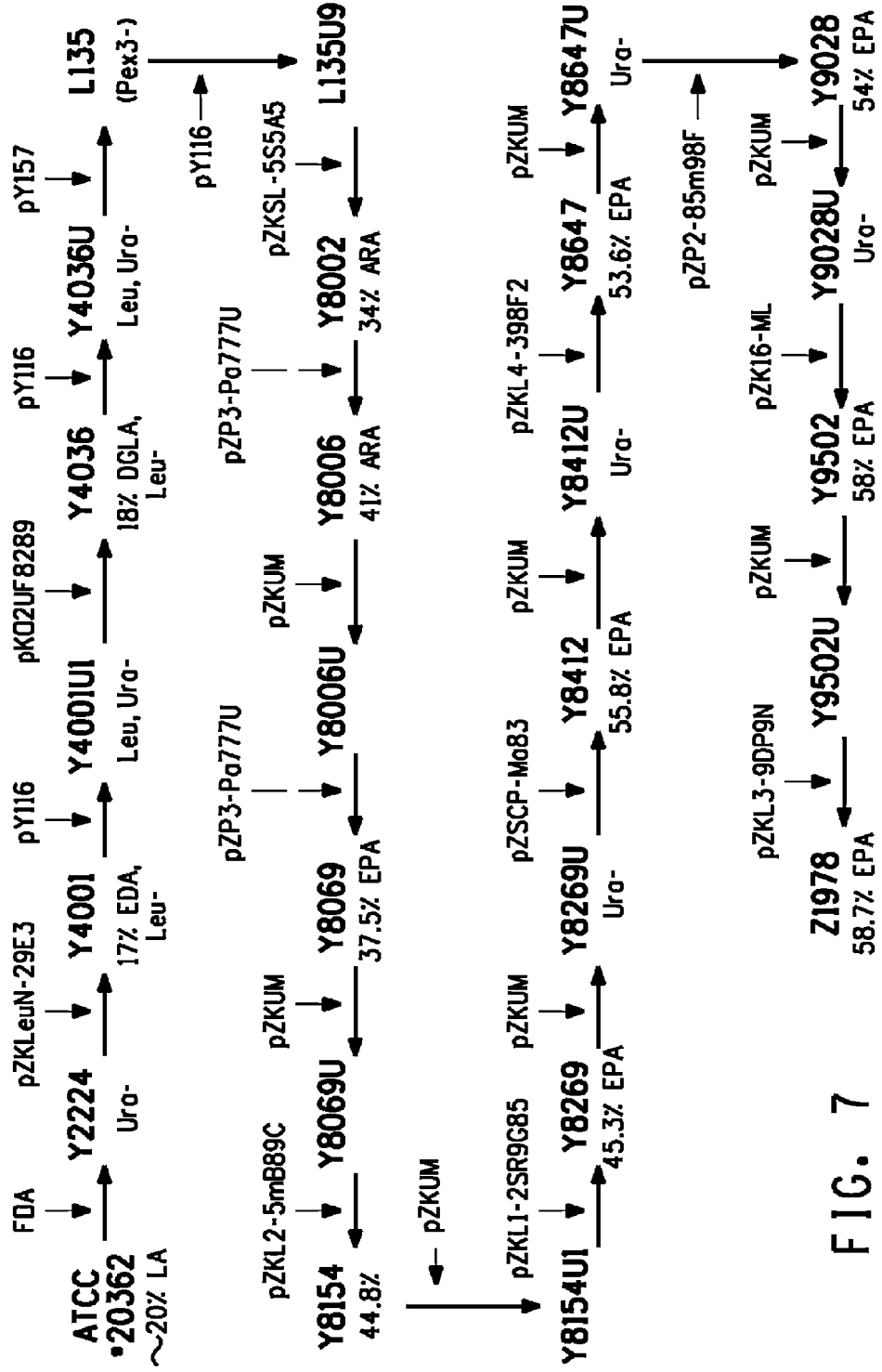

FIG. 7 illustrates development of *Yarrowia lipolytica* strain Z1978.

FIG. 8 provides a plasmid map of the following: (A) pZKUM and (B) pZKL3-9DP9N.

Figure 9:
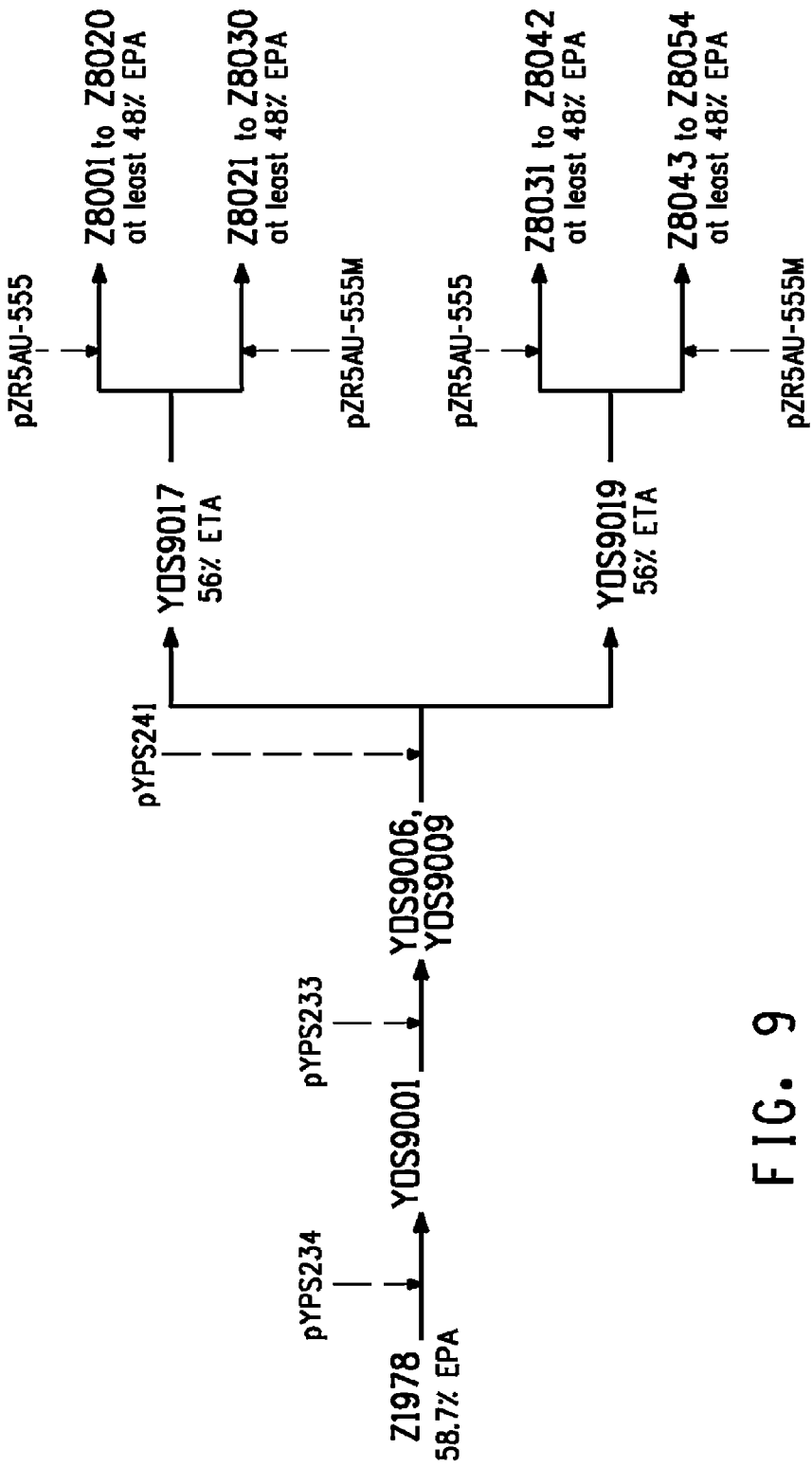

FIG. 9 illustrates development of *Yarrowia lipolytica* strains Z8001 through Z8054.

FIG. 10A schematically illustrates a homologous recombination reaction with pYPS234, while FIG. 10B provides a plasmid map of pYPS234.

Figure 11A:
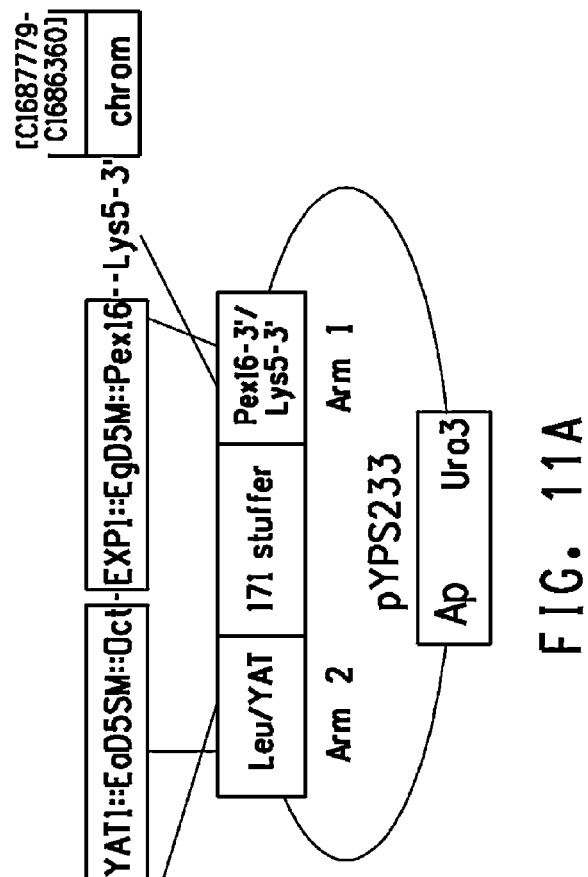
Figure 11B:
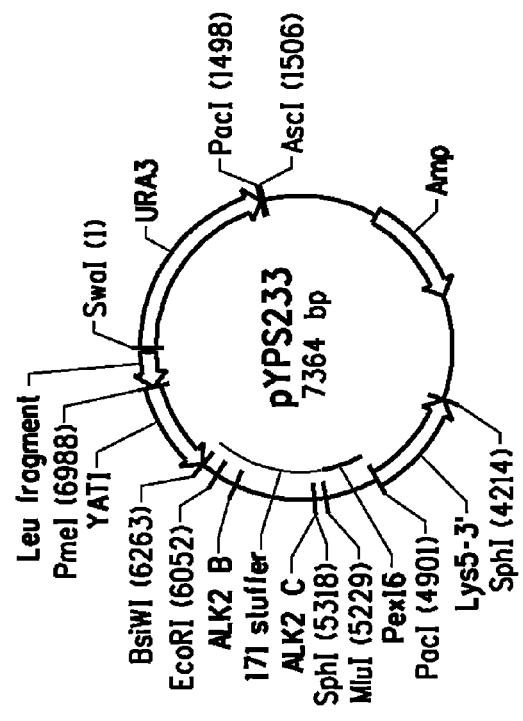

FIG. 11A schematically illustrates a homologous recombination reaction with pYPS233, while FIG. 11B provides a plasmid map of pYPS233.

FIG. 12A schematically illustrates a homologous recombination reaction with pYPS241, while FIG. 12B provides a plasmid map of pYPS241.

FIG. 13 provides plasmid maps of the following: (A) pZR5AU-555 and (B) pZR5AU-555M.

The invention can be more fully understood from the following detailed description and the accompanying sequence descriptions, which form a part of this application.

The following sequences comply with 37 C.F.R. §1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

SEQ ID NOs:1-311 are ORFs encoding genes or proteins (or portions thereof), primers or plasmids, as identified in Table 1.

TABLE 1

Summary Of Nucleic Acid And Protein SEQ ID Numbers

| Description | Nucleic acid SEQ ID NO. | Protein SEQ ID NO. |
|---|---|---|
| His-rich motif: H(X)₃H | — | 1 |
| His-rich motif: H(X)₄H | — | 2 |
| His-rich motif: H(X)₂HH | — | 3 |
| His-rich motif: H(X)₃HH | — | 4 |
| His-rich motif: (H/Q)(X)₂HH | — | 5 |
| His-rich motif: (H/Q)(X)₃HH | — | 6 |
| HPGG motif | — | 7 |
| HDASH motif | — | 8 |
| HgGG motif | — | 9 |
| HhGG motif | — | 10 |
| HPGs motif | — | 11 |
| HcGG motif | — | 12 |
| HwGG motif | — | 13 |
| HaGG motif | — | 14 |
| HDgSH motif | — | 15 |
| HDsSH motif | — | 16 |
| HDAaH motif | — | 17 |
| HDAgH motif | — | 18 |
| HeASH motif | — | 19 |
| *Euglena gracilis* delta-5 desaturase ("EgD5") | 20 (1350 bp) | 21 (449 AA) |
| Synthetic delta-5 desaturase, derived from *Euglena gracilis*, codon-optimized for expression in *Yarrowia lipolytica* ("EgD5S") | 22 (1350 bp) | 23 (449 AA) |
| Variant *Euglena gracilis* delta-5 desaturase, comprising an arginine residue at amino acid position 347 ("EgD5R") | 24 (1350 bp) | 25 (449 AA) |
| Modified variant *Euglena gracilis* delta-5 desaturase comprising an arginine residue at amino acid position 347, with four coding region restriction enzyme sites removed ("EgD5R*") | 26 (1350 bp) | 27 (449 AA) |
| *Euglena anabaena* delta-5 desaturase ("EaD5") | 28 (1362 bp) | 29 (454 AA) |

TABLE 1-continued

Summary Of Nucleic Acid And Protein SEQ ID Numbers

| Description | Nucleic acid SEQ ID NO. | Protein SEQ ID NO. |
|---|---|---|
| Synthetic delta-5 desaturase, derived from *Euglena anabaena*, codon-optimized for expression in *Yarrowia lipolytica* ("EaD5S") | 30 (1362 bp) | 31 (454 AA) |
| HxGG motif | — | 32 |
| HPGx motif | — | 33 |
| HxGx motif | — | 34 |
| HxASH motif | — | 35 |
| HDxSH motif | — | 36 |
| HDAxH motif | — | 37 |
| Plasmid pDMW367 | 38 (8438 bp) | — |
| Plasmid pDMW367-M4 | 39 (8438 bp) | — |
| Oligonucleotide primer pairs utilized to mutate the native EcoRI and BglII restriction enzyme sites of the EgD5R coding region to generate pDMW367-M4 | 40-43 | — |
| Plasmid pDMW367-M2 | 44 (8438 bp) | — |
| Oligonucleotide primer pairs utilized to mutate the native HindIII and NcoI restriction enzyme sites of the EgD5R coding region to generate pDMW367-M4 | 45-48 | — |
| Oligonucleotide primers utilized to individually mutate the Ala residue of the HDASH [SEQ ID NO: 8] motif of EgD5R* by site-directed mutagenesis | 49-86 | — |
| Synthetic mutant delta-5 desaturase, derived from *Euglena gracilis* ("EgD5R*-HDgSH") | — | 87 (449 AA) |
| Synthetic mutant delta-5 desaturase, derived from *Euglena gracilis* ("EgD5R*-HDsSH") | — | 88 (449 AA) |
| Oligonucleotide primers utilized to individually mutate the Ser residue of the HDASH [SEQ ID NO: 8] motif of EgD5R* by site-directed mutagenesis | 89-126 | |
| Synthetic mutant delta-5 desaturase, derived from *Euglena gracilis* ("EgD5R*-HDAaH") | — | 127 (449 AA) |
| Synthetic mutant delta-5 desaturase, derived from *Euglena gracilis* ("EgD5R*-HDAgH") | — | 128 (449 AA) |
| Plasmid pDMW367M4-157g | 129 (8438 bp) | — |
| Plasmid pDMW367M4-158a | 130 (8438 bp) | — |
| Plasmid pDMW367M4-158g | 131 (8438 bp) | — |
| Oligonucleotide primers utilized to individually mutate either the Pro residue or the second Gly residue of the HPGG [SEQ ID NO: 7] motif of mutant delta-5 desaturase genes in pDMW367M4-157g, pDMW367M4-158a, and pDMW367M4-158g by site-directed mutagenesis | 132-137 | — |
| Synthetic mutant delta-5 desaturase, derived from *Euglena gracilis* ("EgD5R*-34g157g") (i.e., comprising HgGG and HDgSH motifs) | 138 (1350 bp) | 139 (449 AA) |
| Synthetic mutant delta-5 desaturase, derived from *Euglena gracilis* ("EgD5R*-34g158a") (i.e., comprising HgGG and HDAaH motifs) | 140 (1350 bp) | 141 (449 AA) |
| Synthetic mutant delta-5 desaturase, derived from *Euglena gracilis* ("EgD5R*-34g158g") (i.e., comprising HgGG and HDAgH motifs) | 142 (1350 bp) | 143 (449 AA) |
| Synthetic mutant delta-5 desaturase, derived from *Euglena gracilis* ("EgD5R*-34h158a") (i.e., comprising HhGG and HDAaH motifs) | 144 (1350 bp) | 145 (449 AA) |
| Synthetic mutant delta-5 desaturase, derived from *Euglena gracilis* ("EgD5R*-34h158g") (i.e., comprising HhGG and HDAgH motifs) | 146 (1350 bp) | 147 (449 AA) |
| Synthetic mutant delta-5 desaturase, derived from *Euglena gracilis* ("EgD5R*-36s158a") (i.e., comprising HPGs and HDAaH motifs) | 148 (1350 bp) | 149 (449 AA) |
| Synthetic mutant delta-5 desaturase, derived from *Euglena gracilis* ("EgD5R*-36s158g") (i.e., comprising HPGs and HDAgH motifs) | 150 (1350 bp) | 151 (449 AA) |
| Synthetic mutant delta-5 desaturase, derived from *Euglena gracilis* ("EgD5R*-34g158g") (i.e., comprising HgGG and HDAgH motifs), codon-optimized for expression in *Yarrowia lipolytica* ("EgD5M") | 152 (1350 bp) | 153 (449 AA) |
| Plasmid pEgD5M | 154 (4070 bp) | — |
| Plasmid pDMW367-5M, comprising EgD5M | 155 (8438 bp) | — |
| Synthetic mutant delta-5 desaturase, derived from *Euglena gracilis* ("EgD5R*-34g158g347s") (i.e., comprising HgGG and HDAgH motifs, and a Ser residue at amino acid position 347) ("EgD5M1") | 156 (1350 bp) | 157 (449 AA) |
| Plasmid pEgD5M1 | 158 (4070 bp) | — |
| Plasmid pDMW367-5M1, comprising EgD5M1 | 159 (8438 bp) | — |

TABLE 1-continued

Summary Of Nucleic Acid And Protein SEQ ID Numbers

| Description | Nucleic acid SEQ ID NO. | Protein SEQ ID NO. |
|---|---|---|
| Synthetic mutant delta-5 desaturase, derived from *Euglena gracilis* and codon optimized for expression in *Yarrowia lipolytica* ("EgD5S-36s") (i.e., comprising a HPGs motif) | — | 160 (449 AA) |
| Plasmid pDMW369S | 161 (8438 bp) | — |
| Oligonucleotide primers utilized to individually mutate the Asp, Ala, or Ser residue of the HDASH [SEQ ID NO: 8] motif of EgD5S-HPGs by site-directed mutagenesis | 162-179 | — |
| Synthetic mutant delta-5 desaturase, derived from *Euglena gracilis* and codon optimized for expression in *Yarrowia lipolytica* ("EgD5S-36s156e") (i.e., comprising HPGs and HeASH motifs) | 180 (1350 bp) | 181 (449 AA) |
| Synthetic mutant delta-5 desaturase, derived from *Euglena gracilis* and codon optimized for expression in *Yarrowia lipolytica* ("EgD5S-36s157g") (i.e., comprising HPGs and HDgSH motifs) | 182 (1350 bp) | 183 (449 AA) |
| Synthetic mutant delta-5 desaturase, derived from *Euglena gracilis* and codon optimized for expression in *Yarrowia lipolytica* ("EgD5S-36s158a") (i.e., comprising HPGs and HDAaH motifs) | 184 (1350 bp) | 185 (449 AA) |
| Synthetic mutant delta-5 desaturase, derived from *Euglena gracilis* and codon optimized for expression in *Yarrowia lipolytica* ("EgD5S-36s158g") (i.e., comprising HPGs and HDAgH motifs) | 186 (1350 bp) | 187 (449 AA) |
| Synthetic mutant delta-5 desaturase, derived from *Euglena anabaena* and codon optimized for expression in *Yarrowia lipolytica* ("EaD5S-35a") (i.e., comprising a HaGG motif) | — | 188 (454 AA) |
| Plasmid pZuFmEaD5S-A(S) | 189 (8357 bp) | — |
| Oligonucleotide primers utilized to individually mutate the Asp, Ala, or Ser residue of the HDASH [SEQ ID NO: 8] motif of EaD5S-35a by site-directed mutagenesis | 190-211 | — |
| Synthetic mutant delta-5 desaturase, derived from *Euglena anabaena* and codon optimized for expression in *Yarrowia lipolytica* ("EaD5S-35a158g") (i.e., comprising HaGG and HDgSH motifs) | 212 (1365 bp) | 213 (454 AA) |
| Synthetic mutant delta-5 desaturase, derived from *Euglena anabaena* and codon optimized for expression in *Yarrowia lipolytica* ("EaD5S-35a158s") (i.e., comprising HaGG and HDsSH motifs) | 214 (1365 bp) | 215 (454 AA) |
| Synthetic mutant delta-5 desaturase, derived from *Euglena anabaena* and codon optimized for expression in *Yarrowia lipolytica* ("EaD5S-35a159g") (i.e., comprising HaGG and HDAgH motifs) | 216 (1365 bp) | 217 (454 AA) |
| Plasmid pZKUM | 218 (4313 bp) | — |
| Plasmid pZKL3-9DPN9N | 219 (13565 bp) | — |
| Synthetic mutant delta-9 elongase derived from *Euglena gracilis* ("EgD9eS-L35G") | 220 (777 bp) | 221 (258 AA) |
| *Yarrowia lipolytica* delta-9 desaturase ("YID9") | 222 (1449 bp) | 223 (482 AA) |
| *Yarrowia lipolytica* choline-phosphate cytidylyltransferase ("YlPCT") | 224 (1101 bp) | 225 (366 AA) |
| Plasmid pZKSL-5S5A5 | 226 (13975 bp) | |
| Plasmid pZP2-85m98F | 227 (14619 bp) | |
| 993 bp stuffer fragment | 228 (993 bp) | — |
| Plasmid pYPS234 | 229 (7338 bp) | — |
| 1019 bp stuffer fragment | 230 (1019 bp) | — |
| Plasmid pYPS233 | 231 (7364 bp) | — |
| Plasmid pYSP241 | 232 (9211 bp) | — |
| Plasmid pZR5AU-555 | 233 (13926 bp) | — |
| Plasmid pZR5AU-555M | 234 (13926 bp) | — |
| HDgnH motif | — | 235 |
| HDAnH motif | — | 236 |
| HefaH motif | — | 237 |
| HeftH motif | — | 238 |
| HemgH motif | — | 239 |
| HeAgH motif | — | 240 |
| HDfgH motif | — | 241 |
| HDygH motif | — | 242 |
| HDscH motif | — | 243 |
| HDAcH motif | — | 244 |
| Primer EgD5-5 | 245 | — |
| Primer EgD5 M1-3 | 246 | — |
| Primer EgD5 M1-5 | 247 | — |

TABLE 1-continued

Summary Of Nucleic Acid And Protein SEQ ID Numbers

| Description | Nucleic acid SEQ ID NO. | Protein SEQ ID NO. |
|---|---|---|
| Primer EgD5-3 | 248 | — |
| Synthetic mutant delta-5 desaturase, derived from *Euglena gracilis* ("EgD5R-34g") (i.e., comprising a HgGG motif) | 249 (1347 bp) | 250 (449 AA) |
| Primer EgD5 M2-3 | 251 | — |
| Primer EgD5 M2-5 | 252 | — |
| Plasmid pLF336 | 253 (5050 bp) | — |
| Synthetic mutant delta-5 desaturase, derived from *Euglena gracilis* ("EgD5R-34g158g") (i.e., comprising HgGG and HDAgH motifs) | 254 (1347 bp) | 255 (449 AA) |
| Primer EgD5 M3-3 | 256 | — |
| Primer EgD5 M3-5 | 257 | — |
| Primer pLF337 | 258 (5050 bp) | — |
| Synthetic mutant delta-5 desaturase, derived from *Euglena gracilis* ("EgD5R-34g158a") (i.e., comprising HgGG and HDAaH motifs) | 259 (1347 bp) | 260 (449 AA) |
| Primer EaD5-5 | 261 | — |
| Primer EaD5 M1-3 | 262 | — |
| Primer EaD5 M1-5 | 263 | — |
| Primer EaD5-3 | 264 | — |
| Synthetic mutant delta-5 desaturase, derived from *Euglena anabaena* ("EaD5-35g") (i.e., comprising a HgGG motif) | 265 (1362 bp) | 266 (454 AA) |
| Primer EaD5 M2-3 | 267 | — |
| Primer EaD5 M2-5 | 268 | — |
| Plasmid pLF338 | 269 (5007 bp) | — |
| Synthetic mutant delta-5 desaturase, derived from *Euglena anabaena* ("EaD5-35g159g") (i.e., comprising HgGG and HDAgH motifs) | 270 (1362 bp) | 271 (454 AA) |
| Primer EaD5 M3-3 | 272 | — |
| Primer EaD5 M3-5 | 273 | — |
| Plasmid pLF339 | 274 (5007 bp) | — |
| Synthetic mutant delta-5 desaturase, derived from *Euglena anabaena* ("EaD5-35g159a") (i.e., comprising HgGG and HDAaH motifs) | 275 (1362 bp) | 276 (454 AA) |
| HDcSH motif | — | 277 |
| HDdSH motif | — | 278 |
| HDeSH motif | — | 279 |
| HDfSH motif | — | 280 |
| HDhSH motif | — | 281 |
| HDiSH motif | — | 282 |
| HDkSH motif | — | 283 |
| HDlSH motif | — | 284 |
| HDmSH motif | — | 285 |
| HDnSH motif | — | 286 |
| HDpSH motif | — | 287 |
| HDqSH motif | — | 288 |
| HDrSH motif | — | 289 |
| HDtSH motif | — | 290 |
| HDvSH motif | — | 291 |
| HDwSH motif | — | 292 |
| HDySH motif | — | 293 |
| HDAcH motif | — | 294 |
| HDAdH motif | — | 295 |
| HDAeH motif | — | 296 |
| HDAfH motif | — | 297 |
| HDAhH motif | — | 298 |
| HDAiH motif | — | 299 |
| HDAkH motif | — | 300 |
| HDAlH motif | — | 301 |
| HDAmH motif | — | 302 |
| HDAnH motif | — | 303 |
| HDApH motif | — | 304 |
| HDAqH motif | — | 305 |
| HDArH motif | — | 306 |
| HDAtH motif | — | 307 |
| HDAvH motif | — | 308 |
| HDAwH motif | — | 309 |
| HDAyH motif | — | 310 |
| HDxxH motif | — | 311 |

DETAILED DESCRIPTION OF THE INVENTION

All patent and non-patent literature cited herein is hereby incorporated by reference in their entirety.

In this disclosure, a number of terms and abbreviations are used. Standard three-letter codes or single-letter codes are used to refer to amino acids. The following definitions are provided.

"Open reading frame" is abbreviated as "ORF".

"Polymerase chain reaction" is abbreviated as "PCR".

"American Type Culture Collection" is abbreviated as "ATCC".

"Polyunsaturated fatty acid(s)" is abbreviated as "PUFA(s)".

"Triacylglycerols" are abbreviated as "TAGs".

"Total fatty acids" are abbreviated as "TFAs".

"Fatty acid methyl esters" are abbreviated as "FAMEs".

"Dry cell weight" is abbreviated as "DCW".

The motif having an amino acid sequence as set forth in SEQ ID NO:7 (i.e., His-Pro-Gly-Gly) is abbreviated as "HPGG".

The motif having an amino acid sequence as set forth in SEQ ID NO:8 (i.e., His-Asp-Ala-Ser-His) is abbreviated as "HDASH".

As used herein the term "invention" or "present invention" is intended to refer to all aspects and embodiments of the invention as described in the claims and specification herein and should not be read so as to be limited to any particular embodiment or aspect.

The term "fatty acids" refers to long chain aliphatic acids (alkanoic acids) of varying chain lengths, from about $C_{12}$ to $C_{22}$, although both longer and shorter chain-length acids are known. The predominant chain lengths are between $C_{16}$ and $C_{22}$. The structure of a fatty acid is represented by a simple notation system of "X:Y", where X is the total number of carbon ["C"] atoms in the particular fatty acid and Y is the number of double bonds. Additional details concerning the differentiation between "saturated fatty acids" versus "unsaturated fatty acids", "monounsaturated fatty acids" versus "polyunsaturated fatty acids" ["PUFAs"], and "omega-6 fatty acids" ["ω-6" or "n-6"] versus "omega-3 fatty acids" ["ω-3"] or ["n-3"] are provided in U.S. Pat. No. 7,238,482, which is hereby incorporated herein by reference.

Nomenclature used to describe PUFAs herein is shown below in Table 2. In the column titled "Shorthand Notation", the omega-reference system is used to indicate the number of carbons, the number of double bonds and the position of the double bond closest to the omega carbon, counting from the omega carbon (which is numbered 1 for this purpose). The remainder of the Table summarizes the common names of omega-3 and omega-6 fatty acids and their precursors, the abbreviations that will be used throughout the specification and the chemical name of each compound.

TABLE 2

Nomenclature Of Polyunsaturated Fatty Acids And Precursors

| Common Name | Abbreviation | Chemical Name | Shorthand Notation |
|---|---|---|---|
| Myristic | — | tetradecanoic | 14:0 |
| Palmitic | Palmitate | hexadecanoic | 16:0 |
| Palmitoleic | — | 9-hexadecenoic | 16:1 |
| Stearic | — | octadecanoic | 18:0 |
| Oleic | — | cis-9-octadecenoic | 18:1 |
| Linoleic | LA | cis-9,12-octadecadienoic | 18:2 ω − 6 |
| γ-Linolenic | GLA | cis-6,9,12-octadecatrienoic | 18:3 ω − 6 |
| Eicosadienoic | EDA | cis-11,14-eicosadienoic | 20:2 ω − 6 |
| Dihomo-γ-Linolenic | DGLA | cis-8,11,14-eicosatrienoic | 20:3 ω − 6 |
| Arachidonic | ARA | cis-5,8,11,14-eicosatetraenoic | 20:4 ω − 6 |
| α-Linolenic | ALA | cis-9,12,15-octadecatrienoic | 18:3 ω − 3 |
| Stearidonic | STA | cis-6,9,12,15-octadecatetraenoic | 18:4 ω − 3 |
| Eicosatrienoic | ETrA | cis-11,14,17-eicosatrienoic | 20:3 ω − 3 |
| Eicosatetraenoic | ETA | cis-8,11,14,17-eicosatetraenoic | 20:4 ω − 3 |
| Eicosapentaenoic | EPA | cis-5,8,11,14,17-eicosapentaenoic | 20:5 ω − 3 |
| Docosatetraenoic | DTA | cis-7,10,13,16-docosatetraenoic | 22:4 ω − 6 |
| Docosapentaenoic | DPAn-6 | cis-4,7,10,13,16-docosapentaenoic | 22:5 ω − 6 |
| Docosapentaenoic | DPA | cis-7,10,13,16,19-docosapentaenoic | 22:5 ω − 3 |
| Docosahexaenoic | DHA | cis-4,7,10,13,16,19-docosahexaenoic | 22:6 ω − 3 |

Although the omega-3/omega-6 PUFAs listed in Table 2 are the most likely to be accumulated in the oil fractions of microbial and plant hosts using the methods described herein, this list should not be construed as limiting or as complete.

The term "oil" refers to a lipid substance that is liquid at 25° C.; the oil is hydrophobic but is soluble in organic solvents. In oleaginous organisms, oil constitutes a major part of the total lipid. "Oil" is composed primarily of triacylglycerols but may also contain other neutral lipids, phospholipids and free fatty acids. The fatty acid composition in the oil and the fatty acid composition of the total lipid are generally similar; thus, an increase or decrease in the concentration of PUFAs in the total lipid will correspond with an increase or decrease in the concentration of PUFAs in the oil, and vice versa.

"Neutral lipids" refer to those lipids commonly found in cells in lipid bodies as storage fats and are so called because, at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or triacylglycerol, respectively, or collectively, acylglycerols. A hydrolysis reaction must occur to release free fatty acids from acylglycerols.

The term "triacylglycerols" ["TAGs"] refers to neutral lipids composed of three fatty acyl residues esterified to a glycerol molecule. TAGs can contain long chain PUFAs and saturated fatty acids, as well as shorter chain saturated and unsaturated fatty acids.

The term "total fatty acids" ["TFAs"] herein refer to the sum of all cellular fatty acids that can be derivitized to fatty acid methyl esters ["FAMEs"] by the base transesterification method (as known in the art) in a given sample, which may be the biomass or oil, for example. Thus, total fatty acids include fatty acids from neutral lipid fractions (including diacylglycerols, monoacylglycerols and TAGs) and from polar lipid fractions (including the phosphatidylcholine and phosphatidylethanolamine fractions) but not free fatty acids.

The term "total lipid content" of cells is a measure of TFAs as a percent of the dry cell weight ["DCW"], although total lipid content can be approximated as a measure of FAMEs as a percent of the DCW ["FAMEs % DCW"]. Thus, total lipid content ["TFAs % DCW"] is equivalent to, e.g., milligrams of total fatty acids per 100 milligrams of DCW.

The concentration of a fatty acid in the total lipid is expressed herein as a weight percent of TFAs ["% TFAs"], e.g., milligrams of the given fatty acid per 100 milligrams of TFAs. Unless otherwise specifically stated in the disclosure herein, reference to the percent of a given fatty acid with respect to total lipids is equivalent to concentration of the fatty acid as % TFAs, e.g., % EPA of total lipids is equivalent to EPA % TFAs.

The terms "lipid profile" and "lipid composition" are interchangeable and refer to the amount of individual fatty acids contained in a particular lipid fraction, such as in the total lipid or the oil, wherein the amount is expressed as a weight percent of TFAs. The sum of each individual fatty acid present in the mixture should be 100.

The term "PUFA biosynthetic pathway" refers to a metabolic process that converts oleic acid to omega-6 fatty acids such as LA, EDA, GLA, DGLA, ARA, DTA and DPAn-6 and omega-3 fatty acids such as ALA, STA, ETrA, ETA, EPA, DPA and DHA. This process is well described in the literature. See e.g., U.S. Pat. No. 7,932,077. Briefly, this process involves elongation of the carbon chain through the addition of carbon atoms and desaturation of the molecule through the addition of double bonds, via a series of special elongation and desaturation enzymes termed "PUFA biosynthetic pathway enzymes" that are present in the endoplasmic reticulum membrane. More specifically, "PUFA biosynthetic pathway enzymes" refer to any of the following enzymes (and genes which encode said enzymes) associated with the biosynthesis of a PUFA, including: delta-4 desaturase, delta-5 desaturase, delta-6 desaturase, delta-12 desaturase, delta-15 desaturase, delta-17 desaturase, delta-9 desaturase, delta-8 desaturase, delta-9 elongase, $C_{14/16}$ elongase, $C_{16/18}$ elongase, $C_{18/20}$ elongase and/or $C_{20/22}$ elongase.

The term "desaturase" refers to a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. Of particular interest herein are delta-5 desaturases that desaturate a fatty acid between the fifth and sixth carbon atom numbered from the carboxyl-terminal end of the molecule and that can, for example, catalyze the conversion of DGLA to ARA and/or ETA to EPA. Other fatty acid desaturases include, for example: delta-8 desaturases, delta-6 desaturases, delta-4 desaturases, delta-12 desaturases, delta-15 desaturases, delta-17 desaturases and delta-9 desaturases. In the art, delta-15 and delta-17 desaturases are also occasionally referred to as "omega-3 desaturases", "w-3 desaturases" and/or "ω-3 desaturases", based on their ability to convert omega-6 fatty acids into their omega-3 counterparts (e.g., conversion of LA into ALA and ARA into EPA, respectively). It may be desirable to empirically determine the specificity of a particular fatty acid desaturase by transforming a suitable host with the gene for the fatty acid desaturase and determining its effect on the fatty acid profile of the host.

The term "EgD5" refers to a delta-5 desaturase (SEQ ID NO:21) from Euglena gracilis, encoded by SEQ ID NO:20 herein. Similarly, the term "EgD5S" refers to a synthetic delta-5 desaturase derived from E. gracilis that is codon-optimized for expression in Yarrowia lipolytica (i.e., SEQ ID NOs:22 and 23). Further details concerning EgD5 and EgD5S are described in U.S. Pat. No. 7,678,560. The term "EgD5R" (i.e., SEQ ID NOs:24 and 25) refers to a variant wildtype EgD5 wherein the amino acid residue at position 347 is arginine. The term "EgD5R*" (i.e., SEQ ID NOs:26 and 27) refers to a modified variant of the wildtype EgD5R, wherein four restriction enzyme sites are removed from the wildtype coding region. The amino acid sequences of EgD5R and EgD5R* are identical.

The term "EaD5" refers to a delta-5 desaturase (SEQ ID NO:29) from Euglena anabaena, encoded by SEQ ID NO:28 herein. Similarly, the term "EaD5S" refers to a synthetic delta-5 desaturase derived from E. anabaena that is codon-optimized for expression in Yarrowia lipolytica (i.e., SEQ ID NOs:30 and 31). Further details concerning EaD5 and EaD5S are described in U.S. Pat. No. 7,943,365.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate that these amino acids may be important in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family. Motifs that are universally found in delta-5 desaturase enzymes of animal, plants and fungi include three histidine boxes (i.e., $H(X)_{3-4}H$ [SEQ ID NOs:1 and 2], $H(X)_{2-3}HH$ [SEQ ID NOs:3 and 4] and $H/Q(X)_{2-3}HH$ [SEQ ID NOs:5 and 6]) and a heme-binding motif (i.e., His-Pro-Gly-Gly or HPGG [SEQ ID NO:7]) within the fused cytochrome $b_5$ domain at the N-terminus. An additional motif (i.e., His-Asp-Ala-Ser-His or HDASH [SEQ ID NO:8]) appears to be conserved in some delta-5 desaturase genes.

The terms "mutant delta-5 desaturase" and "double mutant" refers to a delta-5 desaturase as described herein that has at least one mutation within the HPGG motif (SEQ ID NO:7) of the cytochrome $b_5$ domain and at least one mutation within the HDASH motif (SEQ ID NO:8), wherein said mutations result in an amino acid substitution, either conservative or non-conservative. Although the mutations may include any amino acid substitution, the mutant delta-5 desaturase preferably comprises a mutant HPGG (SEQ ID NO:7) motif having a sequence of His-Xaa-Gly-Xaa or "HxGx" (SEQ ID NO:34) (wherein Xaa can be any amino acid) and a mutant HDASH (SEQ ID NO:8) motif having a sequence of His-Xaa-Xaa-Xaa-His or "HxxxH" (SEQ ID NO:1). More preferably, the mutant delta-5 desaturase comprises a mutant HPGG motif selected from the group consisting of HxGG (SEQ ID NO:32) and HPGx (SEQ ID NO:33), and a mutant HDASH motif selected from the group consisting of HxASH (SEQ ID NO:35), HDxSH (SEQ ID NO:36), and HDAxH (SEQ ID NO:37), where the delta-5 desaturase activity of the mutant delta-5 desaturase is at least about functionally equivalent to the delta-5 desaturase activity of the wildtype delta-5 desaturase. More preferred, the mutant HPGG motif is selected from the group consisting of: SEQ ID NO:9 (HgGG), SEQ ID NO:10 (HhGG), SEQ ID NO:11 (HPGs), SEQ ID NO:12 (HcGG), SEQ ID NO:13 (HwGG) and SEQ ID NO:14 (HaGG), and the mutant HDASH motif is selected from the group consisting of: SEQ ID NO:15 (HDsSH), SEQ ID NO:16 (HDASH), SEQ ID NO:17 (HDAaH), SEQ ID NO:18 (HDAgH), and SEQ ID NO:19 (HeASH).

Each "mutant delta-5 desaturase" has a "corresponding wildtype delta-5 desaturase". Specifically, the mutant delta-5 desaturase and corresponding wildtype delta-5 desaturase share identical amino acid sequences, with the exception that the wildtype will comprise a HPGG motif (SEQ ID NO:7)

within the cytochrome $b_5$ domain and an HDASH motif (SEQ ID NO:8), while the mutant will comprise at least one mutation within each of these motifs (as described above).

A mutant delta-5 desaturase is "at least about functionally equivalent" to the corresponding wildtype delta-5 desaturase when enzymatic activity and specific selectivity of the mutant delta-5 sequence are essentially comparable to that of the corresponding wildtype delta-5 desaturase. Thus, a functionally equivalent mutant delta-5 desaturase will possess delta-5 desaturase activity that is not substantially reduced with respect to that of the corresponding wildtype delta-5 desaturase when the "conversion efficiency" of each enzyme is compared (i.e., a mutant delta-5 desaturase will have at least about 50-64%, more preferably at least 60-74%, more preferably at least about 75-85%, more preferably at least about 85-95%, and most preferably at least about 95% of the enzymatic activity of the wildtype delta-5 desaturase). Although preferred ranges are described above, useful examples of conversion efficiencies include any integer percentage from 50% to 100%, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. The delta-5 desaturase activity of the two polypeptides may be substantially identical. Preferably, the mutant delta-5 desaturase will have increased enzymatic activity and specific selectivity when compared to that of the corresponding wildtype delta-5 desaturase, i.e., having at least about 101%, 102%, 103%, 104% or 105%, more preferably at least about 106%, 107%, 108%, 109%, 110%, 111%, 112%, 113%, 114% or 115% and most preferably at least about 116% or more of the enzymatic activity of the wildtype delta-5 desaturase.

The terms "parent polypeptide" or "parent enzyme" refer to any polypeptide from which a mutant polypeptide or enzyme disclosed herein is derived. The term encompasses wild type, variant wild type, and modified variant wild type polypeptides possessing HPGG (SEQ ID NO:7) and HDASH (SEQ ID NO:8) amino acid motifs, as well as synthetic and codon-optimized polypeptides based thereon. The term further encompasses versions of the foregoing polypeptides from which various restriction enzyme sites have been eliminated.

Mutant delta-5 desaturases are designated using two different nomenclature systems, although both describe the specific sequences of the mutant HPGG (SEQ ID NO:7) motif and HDASH (SEQ ID NO:8) motif in the mutant. The first system specifies the: 1) Wildtype, parent enzyme; 2) hyphen (-); 3) mutant HPGG motif; 4) underscore (_); 5) mutant HDASH motif. The mutant amino acid residue is shown in lower case lettering. Thus, for example, a mutant delta-5 desaturase comprising HaGG (SEQ ID NO:14) and HDsSH (SEQ ID NO:15) motifs, derived from the synthetic delta-5 desaturase that was derived from Euglena graciilis and codon-optimized for expression in Yarrowia lipolytica (i.e., "EgD5S") is referred to as "EgD5S-HPGs_HDsSH". Alternately, this same mutant delta-5 desaturase may also be referred to as "EgD5S-36s157g", using the second system of nomenclature. More specifically, the HPGG (SEQ ID NO:7) motif of EgD5S is located between amino acid residues 33-36, while the HDASH (SEQ ID NO:8) motif of EgD5S is located between amino acid residues 155-159. Thus, "36s" indicates that amino acid residue 36 was modified from the wildtype to Ser, while "157g" indicates that amino acid residue 157 was modified from the wildtype to Gly.

The terms "conversion efficiency" and "percent substrate conversion" refer to the efficiency by which a particular enzyme (e.g., a desaturase) can convert substrate to product. The conversion efficiency is measured according to the following formula: ([product]/[substrate+product])*100. Thus, "DGLA to ARA conversion efficiency" refers to the conversion efficiency by which the substrate, DGLA, is converted to the product, ARA.

The term "elongase" refers to a polypeptide that can elongate a fatty acid carbon chain to produce an acid two carbons longer than the fatty acid substrate that the elongase acts upon. This process of elongation occurs in a multi-step mechanism in association with fatty acid synthase, as described in U.S. Pat. No. 7,659,120. Examples of reactions catalyzed by elongase systems are the conversion of GLA to DGLA, STA to ETA and EPA to DPA.

In general, the substrate selectivity of elongases is somewhat broad but segregated by both chain length and the degree and type of unsaturation. For example, a $C_{14/16}$ elongase will utilize a $C_{14}$ substrate (e.g., myristic acid), a $C_{16/18}$ elongase will utilize a $C_{16}$ substrate (e.g., palmitate), a $C_{18/20}$ elongase will utilize a $C_{18}$ substrate (e.g., GLA, STA, LA, ALA) and a $C_{20/22}$ elongase [also referred to as a delta-5 elongase] will utilize a $C_{20}$ substrate (e.g., ARA, EPA). For the purposes herein, two distinct types of $C_{18/20}$ elongases can be defined: a delta-6 elongase will catalyze conversion of GLA and STA to DGLA and ETA, respectively, while a delta-9 elongase is able to catalyze the conversion of LA and ALA to EDA and ETrA, respectively.

It is important to note that some elongases have broad specificity and thus a single enzyme may be capable of catalyzing several elongase reactions e.g., thereby acting as both a $C_{16/18}$ elongase and a $C_{18/20}$ elongase. It may be desirable to empirically determine the specificity of a fatty acid elongase by transforming a suitable host with the gene for the fatty acid elongase and determining its effect on the fatty acid profile of the host.

Generally, the term "oleaginous" refers to those organisms that tend to store their energy source in the form of oil (Weete, In: Fungal Lipid Biochemistry, $2^{nd}$ Ed., Plenum, 1980). During this process, the cellular oil content of oleaginous microorganisms generally follows a sigmoid curve, wherein the concentration of lipid increases until it reaches a maximum at the late logarithmic or early stationary growth phase and then gradually decreases during the late stationary and death phases (Yongmanitchai and Ward, Appl. Environ. Microbiol., 57:419-25 (1991)). For the purposes of the present application and when used with respect to microorganisms, the term "oleaginous" refers to those microorganisms that can accumulate at least about 25% of their DCW as oil.

The term "oleaginous yeast" refers to those oleaginous microorganisms classified as yeasts that can make oil, i.e., wherein the oil can accumulate in excess of about 25% of their DCW. Examples of oleaginous yeast include, but are no means limited to, the following genera: Yarrowia, Candida, Rhodotorula, Rhodosporidium, Cryptococcus, Trichosporon and Lipomyces. The ability to accumulate oil in excess of about 25% of the DCW of the yeast may be through efforts of recombinant engineering or through the natural abilities of the organism.

Those plants that produce seed from which oil is expressed can be referred to as "oilseed" plants or crops. Examples of oilseed plants include, but are not limited to soybeans, sunflower seed, canola, rapeseed, safflower, flaxseed, mustard seed, peanuts cottonseed, castor beans and sesame.

The term "conservative amino acid substitution" refers to a substitution of an amino acid residue in a given protein with another amino acid, without altering the chemical or functional nature of that protein. For example, it is well known in the art that alterations in a gene that result in the production of a chemically equivalent amino acid at a given site (but do not affect the structural and functional properties of the encoded, folded protein) are common. For the purposes herein, "conservative amino acid substitutions" are defined as exchanges within one of the following five groups:

1. Small aliphatic, nonpolar or slightly polar residues: Ala [A], Ser [S], Thr [T] (Pro [P], Gly [G]);
2. Polar, negatively charged residues and their amides: Asp [D], Asn [N], Glu [E], Gln [Q];
3. Polar, positively charged residues: His [H], Arg [R], Lys [K];
4. Large aliphatic, nonpolar residues: Met [M], Leu [L], Ile [I], Val [V] (Cys [C]); and,
5. Large aromatic residues: Phe [F], Tyr [Y], Trp [W].

Thus, Ala, a slightly hydrophobic amino acid, may be substituted by another less hydrophobic residue (e.g., Gly). Similarly, changes which result in substitution of one negatively charged residue for another (e.g., Asp for Glu) or one positively charged residue for another (e.g., Lys for Arg) can also be expected to produce a functionally equivalent product. As such, conservative amino acid substitutions generally maintain the structure of the polypeptide backbone in the area of the substitution, the charge or hydrophobicity of the molecule at the target site, or the bulk of the side chain. Additionally, in many cases, alterations of the N-terminal and C-terminal portions of the protein molecule would also not be expected to alter the activity of the protein.

The term "non-conservative amino acid substitution" refers to an amino acid substitution that is generally expected to produce the greatest change in protein properties. Thus, for example, a non-conservative amino acid substitution would be one whereby: 1) a hydrophilic residue is substituted for/by a hydrophobic residue (e.g., Ser or Thr for/by Leu, Ile, Val); 2) a Cys or Pro is substituted for/by any other residue; 3) a residue having an electropositive side chain is substituted for/by an electronegative residue (e.g., Lys, Arg or His for/by Asp or Glu); or, 4) a residue having a bulky side chain is substituted for/by one not having a side chain (e.g., Phe for/by Gly). Sometimes, non-conservative amino acid substitutions between two of the five groups will not affect the activity of the encoded protein.

The terms "polynucleotide", "polynucleotide sequence", "nucleic acid sequence", "nucleic acid fragment" and "isolated nucleic acid fragment" are used interchangeably herein. These terms encompass nucleotide sequences and the like. A polynucleotide may be a polymer of RNA or DNA that is single- or double-stranded, that optionally contains synthetic, non-natural or altered nucleotide bases. A polynucleotide in the form of a polymer of DNA may be comprised of one or more segments of cDNA, genomic DNA, synthetic DNA, or mixtures thereof. Nucleotides (usually found in their 5'-monophosphate form) are referred to by a single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T., *Molecular Cloning: A Laboratory Manual*, 2$^{nd}$ ed., Cold Spring Harbor Laboratory: Cold Spring Harbor, N.Y. (1989) ("Sambrook et al."), which is hereby incorporated herein by reference, particularly Chapter 11 and Table 11.1. The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of thermal melting point ["$T_m$"] for hybrids of nucleic acids having those sequences. The relative stability, corresponding to higher $T_m$, of nucleic acid hybridizations decreases in the following order: RNA:RNA, DNA:RNA, DNA:DNA. For hybrids of greater than 100 nucleotides in length, equations for calculating $T_m$ have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as Basic Local Alignment Search Tool ["BLAST"] (Altschul, S. F., et al., *J. Mol. Biol.*, 215: 403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The disclosure herein teaches the complete amino acid and nucleotide sequence encoding particular desaturase proteins. The skilled artisan, having the benefit of the sequences as reported herein, may now use all or a substantial portion of the disclosed sequences for purposes known to those skilled in this art. Accordingly, the complete sequences as reported in the accompanying Sequence Listing, as well as substantial portions of those sequences as defined above, are encompassed in the present disclosure.

The term "complementary" is used to describe the relationship between nucleotide bases that are capable of hybridizing to one another. For example, with respect to DNA, adenosine is complementary to thymine, and cytosine is complementary to guanine. Accordingly, isolated nucleic acid fragments that are complementary to the complete sequences as reported in the accompanying Sequence Listing, as well as those substantially similar nucleic acid sequences, are encompassed in the present disclosure.

The terms "homology" and "homologous" are used interchangeably. They refer to nucleic acid fragments or polypeptides that have similar, but not identical sequence. These terms sometimes also refer to modifications of the nucleic acid fragments (e.g., via deletion or insertion of one or more nucleotides) that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that homologous nucleic acid sequences are also defined by their ability to hybridize, under moderately stringent conditions, e.g., 0.5× SSC, 0.1% SDS, 60° C., with the sequences exemplified herein, or to any portion of the nucleotide sequences disclosed herein and which are functionally equivalent thereto. Stringency conditions can be adjusted to screen for moderately similar fragments, such as homologous sequences from distantly related organisms, to highly similar fragments, such as genes that duplicate functional enzymes from closely related organisms.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

"Sequence identity" or "identity" in the context of nucleic acid or polypeptide sequences refers to the nucleic acid bases or amino acid residues in two sequences that are the same when aligned for maximum correspondence over a specified comparison window.

Methods to determine "percent identity" and "percent similarity" are codified in publicly available computer programs. Percent identity and percent similarity can be readily calculated by known methods, including but not limited to those described in: 1) *Computational Molecular Biology* (Lesk, A. M., Ed.) Oxford University: NY (1988); 2) *Biocomputing: Informatics and Genome Projects* (Smith, D. W., Ed.) Academic: NY (1993); 3) *Computer Analysis of Sequence Data, Part I* (Griffin, A. M., and Griffin, H. G., Eds.) Humania: NJ (1994); 4) *Sequence Analysis in Molecular Biology* (von Heinje, G., Ed.) Academic (1987); and, 5) *Sequence Analysis Primer* (Gribskov, M. and Devereux, J., Eds.) Stockton: NY (1991).

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" and the "Clustal W method of alignment" (described by Higgins and Sharp, *CABIOS*, 5:151-153 (1989); Higgins, D. G. et al., *Comput. Appl. Biosci.*, 8:189-191 (1992)) and found in the MegAlign™ (version 8.0.2) program (supra). After alignment of the sequences using either Clustal program, it is possible to obtain a "percent identity" by viewing the "sequence distances" table in the program.

For multiple alignments using the Clustal V method of alignment, the default values correspond to GAP PENALTY=10 and GAP LENGTH PENALTY=10. Default parameters for pairwise alignments and calculation of percent identity of protein sequences using the Clustal V method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4.

Default parameters for multiple alignment using the Clustal W method of alignment correspond to GAP PENALTY=10, GAP LENGTH PENALTY=0.2, Delay Divergent Seqs(%)=30, DNA Transition Weight=0.5, Protein Weight Matrix=Gonnet Series, DNA Weight Matrix=IUB.

The "BLASTN method of alignment" is an algorithm provided by the National Center for Biotechnology Information ["NCBI"] to compare nucleotide sequences using default parameters, while the "BLASTP method of alignment" is an algorithm provided by the NCBI to compare protein sequences using default parameters.

It is well understood by one skilled in the art that many levels of sequence identity are useful in identifying polypeptides, from other species, wherein such polypeptides have the same or similar function or activity. Suitable nucleic acid fragments, i.e., isolated polynucleotides according to the disclosure herein, encode polypeptides that are at least about 70-85% identical, while more preferred nucleic acid fragments encode amino acid sequences that are at least about 85-95% identical to the amino acid sequences reported herein. Although preferred ranges are described above, useful examples of percent identities include any integer percentage from 50% to 100%, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Also, of interest is any full-length or partial complement of this isolated nucleotide fragment.

Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

"Codon degeneracy" refers to the nature in the genetic code permitting variation of the nucleotide sequence without affecting the amino acid sequence of an encoded polypeptide. Accordingly, described herein is any nucleic acid fragment that encodes all or a substantial portion of the amino acid sequence encoding the instant polypeptides as set forth in SEQ ID NOs:139, 141, 143, 145, 147, 149, 151, 153, 157, 181, 183, 185, 187, 213, 215, 217, 255, 260, 271 and 276.

The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

"Synthetic genes" can be assembled from oligonucleotide building blocks that are chemically synthesized using procedures known to those skilled in the art. These oligonucleotide building blocks are annealed and then ligated to form gene segments that are then enzymatically assembled to construct the entire gene. Accordingly, the genes can be tailored for optimal gene expression based on optimization of nucleotide sequence to reflect the codon bias of the host cell. The skilled artisan appreciates the likelihood of successful gene expression if codon usage is biased towards those codons favored by the host. Determination of preferred codons can be based on a survey of genes derived from the host cell, where sequence information is available. For example, the codon usage profile for *Yarrowia lipolytica* is provided in U.S. Pat. No. 7,125,672.

"Gene" refers to a nucleic acid fragment that expresses a specific protein, and that may refer to the coding region alone or may include regulatory sequences upstream and/or downstream to the coding region (e.g., 5' untranslated regions upstream of the transcription start site of the coding region, 3' non-coding regions). "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene that is introduced into the host organism by gene transfer. Foreign genes can comprise native genes inserted into a non-native organism, native genes introduced into a new location within the native host, or chimeric genes. A "transgene" is a gene that has been introduced into the genome by a transformation procedure. A "codon-optimized gene" is a gene having its frequency of codon usage designed to mimic the frequency of preferred codon usage of the host cell.

"Coding sequence" refers to a DNA sequence that codes for a specific amino acid sequence. "Regulatory sequences" refer to nucleotide sequences located upstream of the coding sequence's transcription start site, 5' untranslated regions and 3' non-coding regions, and which may influence the transcription, RNA processing or stability, or translation of the associated coding sequence. Regulatory sequences may include, but are not limited to: promoters, enhancers, silencers, 5' untranslated leader sequence, introns, polyadenylation recognition sequences, RNA processing sites, effector binding sites and stem-loop structures.

"Promoter" refers to a DNA sequence capable of controlling the expression of a coding sequence or functional RNA. In general, a promoter sequence is located 5' upstream of a coding sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. Promoters that cause a gene to be expressed at almost all stages of cell growth and/or development are commonly referred to as "constitutive promoters". It is further recognized that since in most cases the exact boundaries of regulatory sequences (especially at their 5' end) have not been completely defined, DNA fragments of some variation may have identical promoter activity.

The terms "3' non-coding sequences", "transcription terminator", "terminator" and "termination sequences" refer to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence.

"RNA transcript" refers to the product resulting from RNA polymerase-catalyzed transcription of a DNA sequence. When the RNA transcript is a perfect complementary copy of the DNA sequence, it is referred to as the primary transcript. A RNA transcript is referred to as the mature RNA when it is a RNA sequence derived from post-transcriptional processing of the primary transcript. "Messenger RNA" or "mRNA" refers to the RNA that is without introns and that can be translated into protein by the cell. "cDNA" refers to a DNA that is complementary to, and synthesized from, a mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (U.S. Pat. No. 5,107,065).

The term "operably linked" refers to the association of nucleic acid sequences on a single nucleic acid fragment so that the function of one is affected by the other. For example, a promoter is operably linked with a coding sequence when it is capable of affecting the expression of that coding sequence, i.e., the coding sequence is under the transcriptional control of the promoter. Coding sequences can be operably linked to regulatory sequences in a sense or antisense orientation.

The term "recombinant" refers to an artificial combination of two otherwise separated segments of sequence, e.g., by chemical synthesis or by the manipulation of isolated segments of nucleic acids by genetic engineering techniques.

The term "expression", as used herein, refers to the transcription and stable accumulation of sense (mRNA) or antisense RNA. Expression also includes translation of mRNA into a protein (either precursor or mature).

"Transformation" refers to the transfer of a nucleic acid molecule into a host organism, resulting in genetically stable inheritance. The nucleic acid molecule may be a plasmid that replicates autonomously, for example, or, it may integrate into the genome of the host organism. Host organisms containing the transformed nucleic acid fragments are referred to as "transgenic", "recombinant", "transformed" or "transformant" organisms.

The terms "plasmid" and "vector" refer to an extra chromosomal element often carrying genes that are not part of the central metabolism of the cell, and usually in the form of circular double-stranded DNA fragments. Such elements may have autonomously replicating sequences, genome integrating sequences, phage or nucleotide sequences, and may be linear or circular, of a single- or double-stranded DNA or RNA, derived from any source, in which a number of nucleotide sequences have been joined or recombined into a unique construction which is capable of introducing an expression cassette(s) into a cell.

The term "expression cassette" refers to a fragment of DNA comprising the coding sequence of a selected gene and regulatory sequences preceding (5' non-coding sequences) and following (3' non-coding sequences) the coding sequence that are required for expression of the selected gene product. Thus, an expression cassette is typically composed of: 1) a promoter; 2) a coding sequence (i.e., ORF]); and, 3) a terminator that usually contains a polyadenylation site in eukaryotes. The expression cassette(s) is usually included within a vector, to facilitate cloning and transformation. Different expression cassettes can be transformed into different organisms including bacteria, yeast, plants and mammalian cells, as long as the correct regulatory sequences are used for each host.

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a recombinant construct may comprise one or more expression cassettes. In another example, a recombinant DNA construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used.

The skilled artisan is well aware of the genetic elements that must be present on the vector in order to successfully transform, select and propagate host cells comprising any of the isolated nucleic acid fragments described herein. The skilled artisan will also recognize that different independent transformation events will result in different levels and patterns of expression (Jones et al., *EMBO J.,* 4:2411-2418 (1985); De Almeida et al., *Mol. Gen. Genetics,* 218:78-86 (1989)), and thus that multiple events must be screened in order to obtain strains or lines displaying the desired expression level and pattern. Such screening may be accomplished by Southern analysis of DNA, Northern analysis of mRNA expression, Western analysis of protein expression, or phenotypic analysis, among others.

The terms "host cell" and "host organism" are used interchangeably herein and refer to any organism such as a microorganism or a plant (i.e., an oilseed plant) that is capable of receiving foreign or heterologous genes and capable of expressing those genes. A "recombinant host cell" refers to a host cell that has been recombinantly engineered.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1) the GCG suite of programs (Wisconsin Package Version 9.0, Genetics Computer Group (GCG), Madison, Wis.); 2) BLASTP, BLASTN, BLASTX (Altschul et al., *J. Mol. Biol.,* 215:403-410 (1990)); 3) DNASTAR (DNASTAR, Inc. Madison, Wis.); 4) Sequencher (Gene Codes Corporation, Ann Arbor, Mich.); and, 5) the FASTA program incorporating the Smith-Waterman algorithm (W. R. Pearson, *Comput. Methods Genome Res., [Proc. Int. Symp.]* (1994), Meeting Date 1992, 111-20. Editor(s): Suhai, Sandor. Plenum: New York, N.Y.). Within this description, whenever sequence analysis software is used for analysis, the analytical results are based on the "default values" of the program referenced, unless otherwise specified. As used herein "default values" will mean any set of values or parameters that originally load with the software when first initialized.

Standard recombinant DNA and molecular cloning techniques used herein are well known in the art and are described more fully in Sambrook, et al.; by Silhavy, T. J., Bennan, M. L. and Enquist, L. W., *Experiments with Gene Fusions,* Cold Spring Harbor Laboratory: Cold Spring Harbor, N.Y. (1984) (hereafter "Silhavyu et al."); and by Ausubel, F. M. et al., *Current Protocols in Molecular Biology,* published by Greene Publishing Assoc. and Wiley-Interscience, Hoboken, N.J. (1987) (hereafter "Ausubel et al.").

Figure 1A:
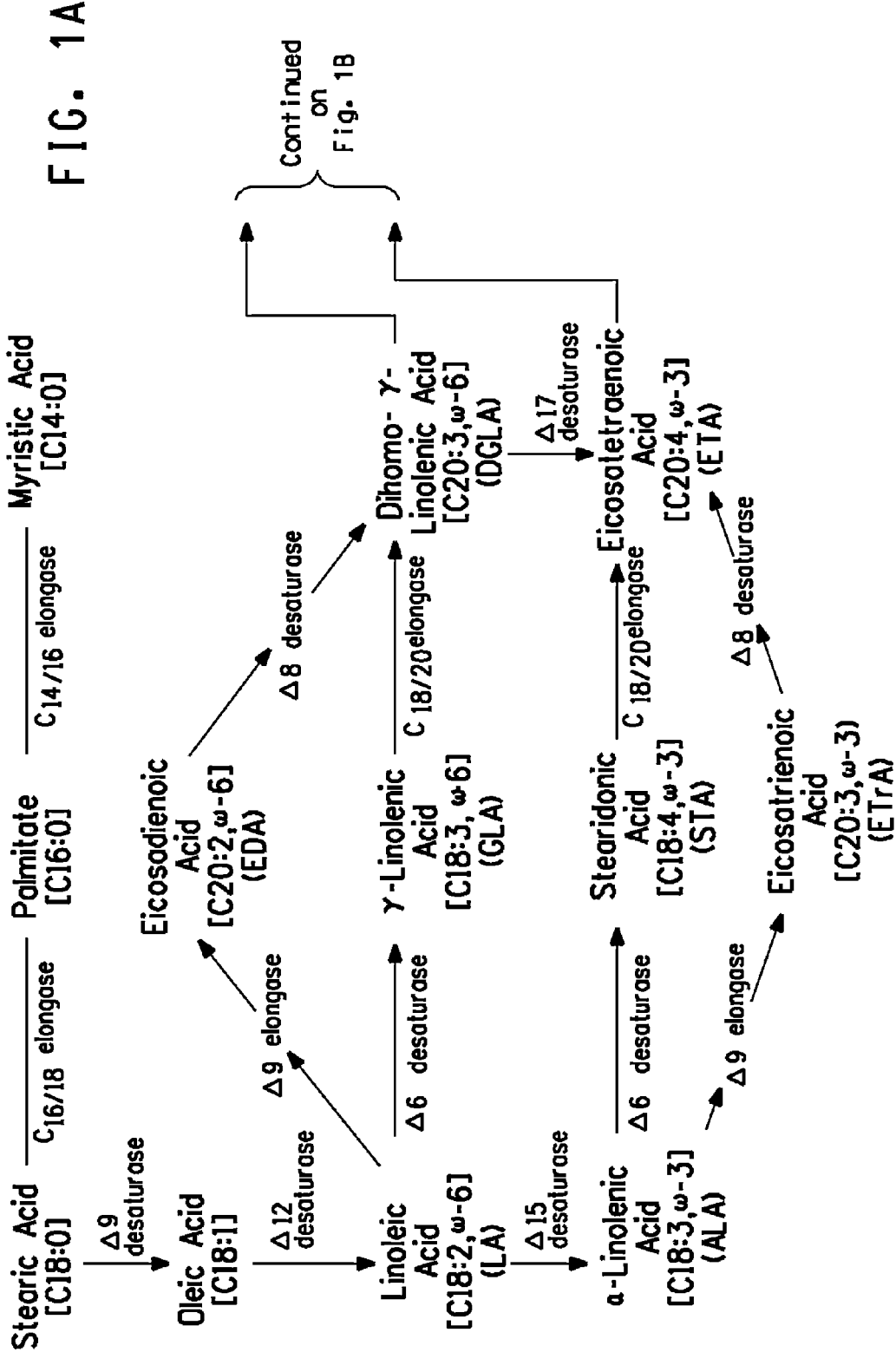
FIG. 1A and FIG. 1B illustrate the omega-3/omega-6 fatty acid biosynthetic pathway and should be viewed together when considering the description of this pathway below.
Figure 1B:
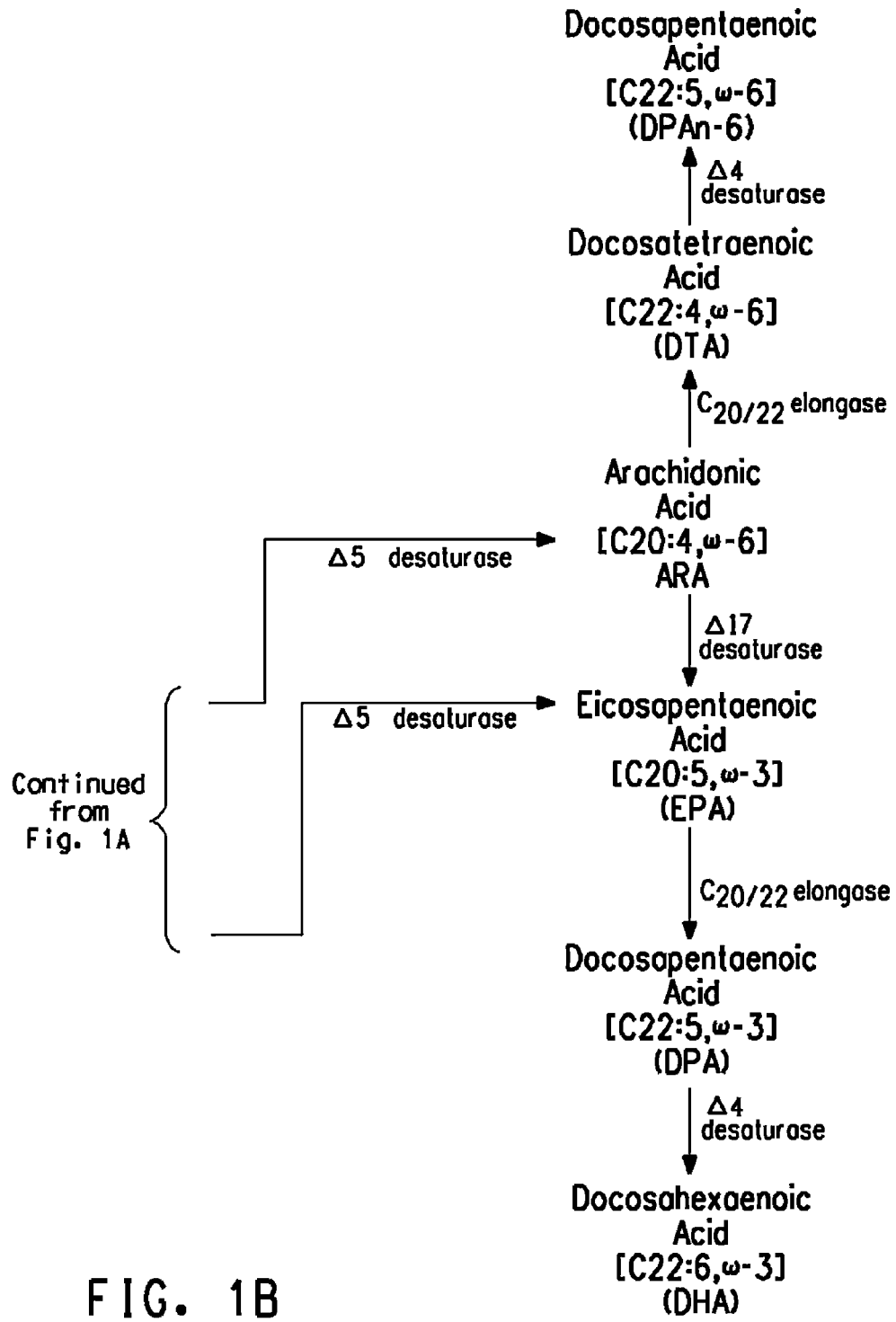

FIG. 1A and FIG. 1B together set forth multiple pathways for omega-3/omega-6 fatty acid production, as described below. All pathways require the initial conversion of oleic acid to linoleic acid ["LA"], the first of the omega-6 fatty acids, by a delta-12 desaturase. Then, using the "delta-9 elongase/delta-8 desaturase pathway" and LA as substrate, long-chain omega-6 fatty acids are formed as follows: 1) LA is converted to eicosadienoic acid ["EDA"] by a delta-9 elongase; 2) EDA is converted to dihomo-γ-linolenic acid ["DGLA"] by a delta-8 desaturase; 3) DGLA is converted to arachidonic acid ["ARA"] by a delta-5 desaturase; 4) ARA is converted to docosatetraenoic acid ["DTA"] by a $C_{20/22}$ elongase; and, 5) DTA is converted to docosapentaenoic acid ["DPAn-6"] by a delta-4 desaturase.

The "delta-9 elongase/delta-8 desaturase pathway" can also use alpha-linolenic acid ["ALA"] as substrate to produce long-chain omega-3 fatty acids as follows: 1) LA is converted to ALA, the first of the omega-3 fatty acids, by a delta-15 desaturase; 2) ALA is converted to eicosatrienoic acid ["ETrA"] by a delta-9 elongase; 3) ETrA is converted to eicosatetraenoic acid ["ETA"] by a delta-8 desaturase; 4) ETA is converted to eicosapentaenoic acid ["EPA"] by a delta-5 desaturase; 5) EPA is converted to docosapentaenoic acid ["DPA"] by a $C_{20/22}$ elongase; and, 6) DPA is converted to docosahexaenoic acid ["DHA"] by a delta-4 desaturase. Optionally, omega-6 fatty acids may be converted to omega-3 fatty acids. For example, ETA and EPA are produced from DGLA and ARA, respectively, by delta-17 desaturase activity.

Alternate pathways for the biosynthesis of omega-3/omega-6 fatty acids utilize a delta-6 desaturase and $C_{18/20}$ elongase, that is, the "delta-6 desaturase/delta-6 elongase pathway". More specifically, LA and ALA may be converted to GLA and stearidonic acid ["STA"], respectively, by a delta-6 desaturase; then, a $C_{18/20}$ elongase converts GLA to DGLA and/or STA to ETA. Downstream PUFAs are subsequently formed as described above.

It is contemplated that the particular functionalities required to be introduced into a specific host organism for production of omega-3/omega-6 fatty acids will depend on the host cell (and its native PUFA profile and/or desaturase/elongase profile), the availability of substrate, and the desired end product(s). For example, expression of the delta-9 elongase/delta-8 desaturase pathway may be preferred in some embodiments, as opposed to expression of the delta-6 desaturase/delta-6 elongase pathway, since PUFAs produced via the former pathway are devoid of GLA and/or STA.

One skilled in the art will be able to identify various candidate genes encoding each of the enzymes desired for omega-3/omega-6 fatty acid biosynthesis. Useful desaturase and elongase sequences may be derived from any source, e.g., isolated from a natural source (from bacteria, algae, fungi, plants, animals, etc.), produced via a semi-synthetic route or synthesized de novo. Although the particular source of the desaturase and elongase genes introduced into the host is not critical, considerations for choosing a specific polypeptide having desaturase or elongase activity include: 1) the substrate specificity of the polypeptide; 2) whether the polypeptide or a component thereof is a rate-limiting enzyme; 3) whether the desaturase or elongase is essential for synthesis of a desired PUFA; 4) co-factors required by the polypeptide; and/or, 5) whether the polypeptide was modified after its production (e.g., by a kinase or a prenyltransferase). The expressed polypeptide preferably has parameters compatible with the biochemical environment of its location in the host cell (see U.S. Pat. No. 7,238,482 for additional details).

It will also be useful to consider the conversion efficiency of each particular desaturase and/or elongase. More specifically, since each enzyme rarely functions with 100% efficiency to convert substrate to product, the final lipid profile of unpurified oils produced in a host cell will typically be a mixture of various PUFAs consisting of the desired omega-3/omega-6 fatty acid, as well as various upstream intermediary PUFAs. Thus, each enzyme's conversion efficiency is also a variable to consider, when optimizing biosynthesis of a desired fatty acid.

With each of the considerations above in mind, candidate genes having the appropriate desaturase and elongase activities (e.g., delta-6 desaturases, $C_{18/20}$ elongases, delta-5 desaturases, delta-17 desaturases, delta-15 desaturases, delta-9 desaturases, delta-12 desaturases, $C_{14/16}$ elongases, $C_{16/18}$ elongases, delta-9 elongases, delta-8 desaturases, delta-4 desaturases and $C_{20/22}$ elongases) can be identified according to publicly available literature (e.g., GenBank), the patent literature, and experimental analysis of organisms having the ability to produce PUFAs. These genes will be suitable for introduction into a specific host organism, to enable or enhance the organism's synthesis of PUFAs.

Once fatty acids are synthesized within an organism (including saturated and unsaturated fatty acids and short-chain and long-chain fatty acids), they may be incorporated into TAGs. TAGs are the primary storage unit for fatty acids.

Most delta-5 desaturase enzymes identified thus far have the primary ability to convert DGLA to ARA, with secondary activity in converting ETA to EPA. Several delta-5 desaturases have been disclosed in both the open literature and the patent literature. General characteristics of delta-5 desaturases, based on desaturase evolution, are well-described by P. Sperling et al. (*Prostaglandins Leukot. Essent. Fatty Acids*, 68:73-95 (2003). Along with delta-6, delta-8 and delta-4 desaturases, delta-5 desaturases are known as long-chain PUFA "front-end" desaturases (wherein desaturation occurs between a pre-existing double bond and the carboxyl terminus of the fatty acid's acyl group, as opposed to methyl-directed desaturation). These desaturases are characterized by three histidine boxes [$H(X)_{3-4}H$ (SEQ ID NOs:1 and 2), $H(X)_{2-3}HH$ (SEQ ID NOs:3 and 4) and $H/Q(X)_{2-3}HH$ (SEQ ID NOs:5 and 6)] and are members of the cytochrome $b_5$ fusion superfamily, since they possess a fused cytochrome $b_5$ domain at their N-terminus which serves as an electron donor. The cytochrome $b_5$ domain also contains a conserved heme-binding motif (i.e., a HPGG sequence [SEQ ID NO:7]), despite divergence of the remaining cytochrome $b_5$ domain sequences. An additional motif previously identified in some delta-5 desaturases also appears to be rich in histidine (i.e., a HDASH sequence [SEQ ID NO:8]), although the importance of the HDASH motif to enzymatic activity has yet to be elucidated.

A number of studies have suggested that the HPGG (SEQ ID NO:7) motif is implicated in enzyme activity. Sayanova, O. et al. (Plant Physiol., 121:641 (1999)) performed site-directed mutagenesis to replace the His residue of the HPGG motif with an Ala residue in the delta-6 desaturase of borage. The mutant enzyme was expressed in *Arabidopsis*; however, no enzymatic activity could be measured, suggesting that the His residue of the HPGG (SEQ ID NO:7) motif in the cytochrome $b_5$ domain of the desaturase was important for function. A similar study was performed in a rat delta-6 desaturase, where an Ala for His substitution was engineered within the HPGG (SEQ ID NO:7) motif. The mutated protein also had no activity (Guillou, H., et al., *J. Lipid Res.,* 45:32-40 (2004)). More recently, Hongsthong, A. et al. (*Appl. Microbiol. Biotechnol.,* 72:1192-1201 (2006)) reported substitution of the His residue of the HPGG (SEQ ID NO:7) motif with an Ala residue in the delta-6 desaturase of *Spirulina*. As with previous reports, the mutation rendered the mutant enzyme unable to produce GLA in *E. coli*, suggesting that the cytochrome $b_5$ domain was important for activity and alterations at the His residue in the HPGG (SEQ ID NO:7) motif will result in diminished enzyme activity. Although delta-5 desaturase enzymes are relatively common and well characterized, there remains a need for enzymes that are efficiently expressed at high levels in production host cells capable of making PUFAs.

As was mentioned above, delta-5 desaturases contain several conserved sequences. However, only the heme-binding motif (i.e., HPGG [SEQ ID NO:7]) and the HDASH motif (SEQ ID NO:8) lack variation within the sequence. These motifs were selected as targets for mutagenesis herein. Although the importance of the HDASH (SEQ ID NO:8) motif to enzymatic function remains unclear, the literature suggests that at least the His residue within the HPGG (SEQ ID NO:7) motif is important for function. Consequently, substitutions for the His residues in either motif were avoided in favor of substitutions for the remaining residues.

U.S. Pat. Pub. No. 2010-0075386-A1 describes the site-directed mutagenesis of the Pro and the second Gly residues within the HPGG (SEQ ID NO:7) motif of several delta-5 desaturases, followed by expression of the resulting mutant polypeptides and determination of their activities with respect to that of the wildtype enzyme. That application disclosed the creation of various mutant delta-5 desaturases comprising amino acid mutant motifs including HxGG (SEQ ID NO:32) and HPGx (SEQ ID NO:33), where the delta-5 desaturase activity of the mutant delta-5 desaturase was functionally equivalent to the delta-5 desaturase activity of the corresponding wildtype delta-5 desaturase.

Numerous site-directed mutagenesis protocols exist [e.g., Ishii, T. M., et al., *Methods Enzymol.,* 293:53-71 (1998); Ling M. M. and B. H. Robinson, *Anal. Biochem.,* 254:157-178 (1997); Braman J. (ed.) *In Vitro Mutagenesis Protocols. $2^{nd}$ Ed.,* Humania: Totowa, N.J. (2002); Kunkel T. A., et al., *Methods Enzymol.,* 154:367-382 (1987); Sawano A. and Miyawaki, A. *Nucleic Acids Res.,* 28:e78 (2000)]; however, the QuikChange® site-directed mutagenesis kit (Stratagene, La Jolla, Calif.) was selected for use based on its facile implementation and high efficiency. The basic procedure utilizes a supercoiled double-stranded DNA vector with an insert of interest and two synthetic oligonucleotide primers containing the desired mutation. The oligonucleotide primers, each complementary to opposite strands of the vector, are extended during temperature cycling by a DNA polymerase. Incorporation of the oligonucleotide primers generates a mutated plasmid containing staggered nicks. Following temperature cycling, the product is treated with DpnI endonuclease (specific for methylated and hemi-methylated DNA) as a means to digest the parental DNA template and to select for newly synthesized mutant DNA. The nicked vector DNA containing the desired mutations is then transformed and propagated in an *Escherichia coli* host.

Using the techniques described above, site-directed mutagenesis was independently performed on the Asp [D], Ala [A] and Ser [S] residues within the HDASH (SEQ ID NO:8) motif of several delta-5 desaturases, followed by expression of the resulting mutant polypeptides and determination of their activities with respect to that of the wildtype enzyme. Surprisingly, various mutant delta-5 desaturases were created comprising amino acid mutant motifs including HxASH (SEQ ID NO:35), HDxSH (SEQ ID NO:36) and HDAxH (SEQ ID NO:37), where the delta-5 desaturase activity of the mutant delta-5 desaturase was functionally similar to the delta-5 desaturase activity of the corresponding wildtype delta-5 desaturase.

For example, all possible amino acid substitutions for the Ala residue within the HDASH (SEQ ID NO:8) motif were introduced by site-directed mutagenesis into a modified variant wildtype delta-5 desaturase derived from *Euglena gracilis* within a plasmid construct comprising a chimeric FBAIN:: EgD5R*::Pex20 gene (i.e., EgD5R* [SEQ ID NO:27], lacking four internal restriction enzyme sites within the gene and comprising an Arg at position 347 instead of a Ser, when compared to EgD5 [SEQ ID NO:21]). The plasmids with the mutated sequences were individually transformed into *E. coli*, sequenced and then transformed into an appropriate strain of *Yarrowia lipolytica* previously engineered to produce ~18% DGLA. This enabled screening for delta-5 desaturase activity based on the production of ARA (i.e., by GC analyses).

Many mutations were identified that resulted in mutant delta-5 desaturases having substantially decreased delta-5 desaturase activities with respect to the wildtype enzyme. Surprisingly, however, the preliminary screening identified two amino acid residues that could be substituted for the Ala within the HDASH (SEQ ID NO:8) motif and that resulted in approximately equivalent or increased delta-5 desaturase activity in the mutant, when compared to the delta-5 desaturase activity in the corresponding wildtype enzyme (i.e., EgD5R*). Thus, this preliminary experimentation suggested that the Ala residue within the HDASH (SEQ ID NO:8) motif could be substituted with Gly or Ser without significantly affecting the delta-5 desaturase activity of EgD5R*.

Similar experimentation was performed using EgD5R* as the template in site-directed mutagenesis reactions, where the Ser residue of the HDASH (SEQ ID NO:8) motif was mutated. Analyses of the mutant enzymes determined that two amino acid residues (i.e., Ala or Gly) were sufficient to replace the wildtype amino acid (i.e., Ser) and resulted in a mutant EgD5R* enzyme having equivalent or improved delta-5 desaturase activity.

Once the preliminary analyses of amino acid substitutions in the HDASH (SEQ ID NO:8) motif of EgD5R* were completed as described above, oligonucleotide-mediated site-directed mutagenesis was further utilized to create specific point mutations within the HPGG (SEQ ID NO:7) motif in combination with several mutant HDASH motifs of delta-5 desaturases described above. Thus, various amino acid substitutions within the HPGG (SEQ ID NO:7) motif were introduced by site-directed mutagenesis into each of three of the mutant HDASH motif delta-5 desaturases described above (i.e., EgD5R*-157g [SEQ ID NO:87], EgD5R*-158a [SEQ ID NO:127] and EgD5R*-158g [SEQ ID NO:128]), within plasmids pDMW367M4-157g (SEQ ID NO:129), pDMW367M4-158a (SEQ ID NO:130), and pDMW367M4-158g (SEQ ID NO:131), respectively, thereby generating double mutants having a single mutation within each of the HPGG (SEQ ID NO:7) and HDASH (SEQ ID NO:8) motifs. The double mutants were amplified in *E. coli*, confirmed by DNA sequencing and then transformed into an appropriate strain of *Y. lipolytica*. Again, screening for delta-5 desaturase activity based on the production of ARA (i.e., by GC analyses) was performed.

All of the double mutants possessed some detectable level of delta-5 desaturase activity with respect to the non-mutant wildtype EgD5R* enzyme. More specifically, all 7 of the mutant delta-5 desaturases functioned with at least 64% DGLA to ARA conversion efficiency with respect to the corresponding wildtype EgD5R* control, while 3 were able to convert DGLA to ARA with at least 83% conversion efficiency (Table 3, infra). The screening confirmed the Pro and the second Gly of the HPGG (SEQ ID NO:7) motif and the Ala and Ser of the HDASH (SEQ ID NO:8) motif could be simultaneously substituted and yield a double mutant having approximately equivalent delta-5 desaturase activity, when compared to the delta-5 desaturase activity in the corresponding wildtype enzyme (i.e., EgD5R*). Thus, this experimentation suggested 1) that the Pro residue within the HPGG [SEQ ID NO:7] motif can be substituted with Gly with simultaneous substitution of either: a) the Ala residue within the HDASH [SEQ ID NO:8] motif for Gly or b) the Ser residue within the HDASH [SEQ ID NO:8] motif for Ala or Gly; 2) the Pro residue within the HPGG [SEQ ID NO:7] motif can also be substituted with His with simultaneous substitution of the Ser within the HDASH [SEQ ID NO:8] motif for either Ala or Gly; and, 3) the second Gly residue within the HPGG [SEQ ID NO:7] motif can be substituted with Ser with simultaneous substitution of the Ser within the HDASH [SEQ ID NO:8] motif for either Ala or Gly, without significantly affecting the delta-5 desaturase activity of EgD5R*.

The N-terminus of the gene encoding the double mutant EgD5R* delta-5 desaturase identified as having the highest conversion efficiency as compared to EgD5R* (i.e., EgD5R*-34g158g; SEQ ID NO:142) was codon-optimized for expression in *Yarrowia lipolytica* (i.e., EgD5M; SEQ ID NO:152). EgD5M was then modified to encode a Ser at position 347 (i.e., EgD5M1; SEQ ID NO:156) in order to analyze the effect of the R347S mutation on delta-5 desaturase activity. Plasmids comprising either EgD5M (i.e., pDMW367-5M; SEQ ID NO:155) or EgD5M1 (i.e., pDMW367-5M1; SEQ ID NO:159) were separately transformed into an appropriate strain of *Y. lipolytica*, and the delta-5 desaturase activity and conversion efficiency were measured and compared to that of wild-type EgD5R*.

Both double mutant delta-5 desaturases, i.e., EgD5M and EgD5M1, had increased activity compared to the wild-type EgD5R* (Table 3, infra). Surprisingly, EgD5M1 demonstrated improved delta-5 desaturase activity as compared to EgD5M, suggesting that a Ser at amino acid residue 347 improved the enzymatic activity.

Using the techniques described above, single amino acid substitutions were then individually introduced by site-directed mutagenesis into the Asp, Ala, or Ser residues of the HDASH (SEQ ID NO:8) motif of a synthetic delta-5 desaturase having a mutant HPGs (SEQ ID NO:11) motif, which was codon-optimized for expression in *Yarrowia lipolytica* and derived from *Euglena gracilis* (i.e., EgD5S-36s [SEQ ID NO:160]; U.S. Pat. Appl. Pub. No. 2010-0075386-A1), within a plasmid construct comprising a chimeric FBAIN::EgD5S-36s::Pex20 gene. The protocol was repeated using a synthetic delta-5 desaturase having a mutant HaGG (SEQ ID NO:14) motif, which was codon-optimized for expression in *Y. lipolytica* and derived from *Euglena anabaena* (i.e., EaD5S-35a [SEQ ID NO:188]; U.S. Pat. Appl. Pub. No. 2010-0075386-A1). The plasmids with double mutants were separately amplified in *E. coli*, confirmed by DNA sequencing, and then transformed into an appropriate strain of *Y. lipolytica* for delta-5 desaturase activity screening based on the production of ARA (i.e., by GC analyses). Double mutant delta-5 desaturases were obtained from each experiment, comprising HxGx (SEQ ID NO:34) and HxxxH (SEQ ID NO:1) motifs and having suitable delta-5 desaturase activity (see Examples for additional details and Table 3, infra).

TABLE 3

Preferred Mutant Delta-5 Desaturases Comprising HxGx (SEQ ID NO: 34) and HxxxH (SEQ ID NO: 1) Motifs

| Mutant Delta-5 Desaturase (SEQ ID NO) | Mutant HPGG Motif | Mutant HDASH Motif | Delta-5 Desaturase Activity |
|---|---|---|---|
| EgD5R*-34g157g (SEQ ID NO: 139) | HgGG (SEQ ID NO: 9) | HDgSH (SEQ ID NO: 15) | 83%[a] |
| EgD5R*-34g158a (SEQ ID NO: 141) | HgGG (SEQ ID NO: 9) | HDAaH (SEQ ID NO: 17) | 88%[a] |
| EgD5R*-34g158g (SEQ ID NO: 143) | HgGG (SEQ ID NO: 9) | HDAgH (SEQ ID NO: 18) | 97%[a] |
| EgD5M (codon-optimized EgD5R*-34g158g) (SEQ ID NO: 153) | HgGG (SEQ ID NO: 9) | HDAgH (SEQ ID NO: 18) | 106.9%[a] |
| EgD5M1 (codon-optimized EgD5R*-34g158g347s) (SEQ ID NO: 157) | HgGG (SEQ ID NO: 9) | HDAgH (SEQ ID NO: 18) | 111.3%[a] |
| EgD5S-36s157g (SEQ ID NO: 183) | HPGs (SEQ ID NO: 11) | HDgSH (SEQ ID NO: 15) | 79.9%[b] |
| EgD5S-36s158a (SEQ ID NO: 185) | HPGs (SEQ ID NO: 11) | HDAaH (SEQ ID NO: 17) | 85.4%[b] |
| EgD5S-36s158g (SEQ ID NO: 187) | HPGs (SEQ ID NO: 11) | HDAgH (SEQ ID NO: 18) | 74.9%[b] |
| EgD5S-36s156e (SEQ ID NO: 181) | HPGs (SEQ ID NO: 11) | HeASH (SEQ ID NO: 19) | 79.0%[b] |
| EaD5S-35a158g (SEQ ID NO: 213) | HaGG (SEQ ID NO: 14) | HDgSH (SEQ ID NO: 15) | 76.3%[c] |
| EaD5S-35a158s (SEQ ID NO: 215) | HaGG (SEQ ID NO: 14) | HDsSH (SEQ ID NO: 16) | 73.7%[c] |
| EaD5S-35a159g (SEQ ID NO: 217) | HaGG (SEQ ID NO: 14) | HDAgH (SEQ ID NO: 18) | 71.2%[c] |

[a]Delta-5 desaturase activity is with respect to the corresponding wildtype enzyme having a HPGG (SEQ ID NO: 7) and a HDASH (SEQ ID NO: 8) motif.
[b]Delta-5 desaturase activity is with respect to the corresponding parent enzyme having only a mutant HPGs (SEQ ID NO: 11) motif.
[c]Delta-5 desaturase activity is with respect to the corresponding parent enzyme having only a mutant HaGG (SEQ ID NO: 14) motif.

The above studies do not suggest a consensus with respect to which particular simultaneous amino acid substitutions in the HPGG (SEQ ID NO:7) and HDASH (SEQ ID NO:8) motifs are sufficient to produce a mutant polypeptide having acceptable delta-5 desaturase activity. However, contrary to previous reports in the art, the data is surprising in demonstrating that substitutions for either the Pro or Gly residues of the HPGG (SEQ ID NO:7) motif combined with substitutions for the Asp, Ala or Ser residues of the HDASH (SEQ ID NO:8) motif may result in an enzyme having functionally equivalent or improved delta-5 desaturase activity, as compared to its wildtype parent.

Accordingly, it is within the scope of the present invention to provide a polypeptide having delta-5 desaturase activity comprising a first amino acid motif selected from the group consisting of: SEQ ID NO:9 (HgGG), SEQ ID NO:10 (HhGG), SEQ ID NO:11 (HPGs), SEQ ID NO:12 (HcGG), SEQ ID NO:13 (HwGG) and SEQ ID NO:14 (HaGG); and a second amino acid motif selected from the group consisting of: SEQ ID NO:15 (HDsSH), SEQ ID NO:16 (HDASH), SEQ ID NO:17 (HDAaH), SEQ ID NO:18 (HDAgH) and SEQ ID NO:19 (HeASH).

More preferably, the mutant delta-5 desaturase described above (i.e., comprising a HxGx [SEQ ID NO:34] motif and a mutant HxxxH [SEQ ID NO:1] motif additionally has delta-5 desaturase activity that is at least 64% of that of the corresponding wildtype delta-5 desaturase having both an HPGG (SEQ ID NO:7) and HDASH (SEQ ID NO:8) amino acid motif.

The mutant delta-5 desaturase polypeptide comprising a mutant HPGG motif and a mutant HDASH motif may have at least 90% sequence identity, and more preferably at least 95% sequence identity, based on the BLASTP method of alignment when compared to a polypeptide having a sequence selected from the group consisting of: SEQ ID NO:21, SEQ ID NO:25 and SEQ ID NO:29.

In some embodiments, the polypeptide has an amino acid sequence selected from the group consisting of: SEQ ID NO:139, SEQ ID NO:141, SEQ ID NO:143, SEQ ID NO:145 [EgD5R*-34h158a], SEQ ID NO:147 [EgD5R*-34h158g], SEQ ID NO:149 [EgD5R*-36s158a], SEQ ID NO:151 [EgD5R*-36s158g], SEQ ID NO:153, SEQ ID NO:157, SEQ ID NO:181, SEQ ID NO:183, SEQ ID NO:185, SEQ ID NO:187, SEQ ID NO:213, SEQ ID NO:215, SEQ ID NO:217, SEQ ID NO:255 [EgD5R-34g158g], SEQ ID NO:260 [EgD5R-34g158a], SEQ ID NO:271 [EaD5-35g159g] and SEQ ID NO:276 [EaD5-35g159a].

It will be appreciated by one of skill in the art that useful mutant delta-5 desaturases are not limited to the mutations described above. Instead, the results suggest that similar experimentation could be performed using any delta-5 wildtype desaturase enzyme having a HPGG (SEQ ID NO:7) motif within the cytochrome $b_5$ domain and an HDASH motif (SEQ ID NO:8), to thereby engineer a mutant delta-5 desaturase having suitable delta-5 desaturase activity wherein the mutation would result in a mutant HxGG (SEQ ID NO:32) or a HPGx motif (SEQ ID N0:33) and a mutant HxASH (SEQ ID NO:35), HDxSH (SEQ ID NO:36) or HDAxH motif (SEQ ID NO:37). A mutant enzyme having suitable delta-5 desaturase activity can be useful to enable increased production of omega-3/omega-6 fatty acids.

For example, in vitro mutagenesis and selection or error prone PCR (Leung et al., Techniques, 1:11-15 (1989); Zhou et al., Nucleic Acids Res., 19:6052-6052 (1991); Spee et al., Nucleic Acids Res., 21:777-778 (1993); Melnikov et al., Nucleic Acids Res., 27(4):1056-1062 (Feb. 15, 1999)) could also be employed as a means to obtain mutations of naturally occurring delta-5 desaturase genes, wherein the mutations may include deletions, insertions and point mutations, or combinations thereof. The principal advantage of error-prone PCR is that all mutations introduced by this method will be within the desired desaturase gene, and any change may be easily controlled by changing the PCR conditions. Alternatively, in vivo mutagenesis may be employed using commercially available materials such as the E. coli XL1-Red strain and Epicurian coli XL1-Red mutator strain from Stratagene (La Jolla, Calif.; Greener and Callahan, Strategies, 7:32-34 (1994)). This strain is deficient in three of the primary DNA repair pathways (mutS, mutD and mutT), resulting in a mutation rate 5000-fold higher than that of wildtype. In vivo mutagenesis does not depend on ligation efficiency (as with error-prone PCR); however, a mutation may occur at any region of the vector and the mutation rates are generally much lower.

It is also contemplated that a mutant delta-5 desaturase with altered or enhanced delta-5 desaturase activity may be constructed using the method of "gene shuffling" (U.S. Pat. No. 5,605,793; U.S. Pat. No. 5,811,238; U.S. Pat. No. 5,830,721; U.S. Pat. No. 5,837,458). The method of gene shuffling is particularly attractive due to its facile implementation and high rate of mutagenesis. The process of gene shuffling involves the restriction of a gene of interest into fragments of specific size in the presence of additional populations of DNA regions of both similarity to (or difference to) the gene of interest. This pool of fragments will denature and then reanneal to create a mutated gene. The mutated gene is then screened for altered activity. Any of these methods may be used to create delta-5 desaturase mutant enzymes having the substituted motifs HxGG (SEQ ID NO:32) or HPGx (SEQ ID NO:33), and HxASH (SEQ ID NO:35), HDxSH (SEQ ID NO:36), or HDAxH (SEQ ID NO:37), which may then be screened for suitable activity using the methods described herein.

It is expected that introduction of chimeric genes encoding the mutant delta-5 desaturases described herein (i.e., wherein said mutant delta-5 desaturase comprises at least one mutation in a region encoding an HPGG amino acid motif and at least one mutation in a region encoding an HDASH amino acid motif, and wherein said mutant delta-5 desaturase preferably has at least 64% delta-5 desaturase activity with respect to that of the corresponding wildtype delta-5 desaturase), under the control of the appropriate promoters will result in production of ARA and/or EPA in the transformed host organism, respectively. As such, disclosed herein are methods for the direct production of PUFAs comprising exposing a fatty acid substrate (i.e., DGLA and/or ETA) to a mutant desaturase described herein (e.g., any of SEQ ID NOs:139, 141, 143, 145, 147, 149, 151, 153, 157, 181, 183, 185, 187, 213, 215, 217, 255, 260, 271 and 276), such that the substrate is converted to the desired fatty acid product (i.e., ARA and/or EPA, respectively).

More specifically, described herein is a method for the production of a PUFA in a microbial host cell (e.g., bacteria, yeast, algae, euglenoids, stramenopiles, oomycetes and fungi) or a plant host cell (e.g., an oilseed plant cell), wherein the microbial or plant host cell comprises:

a) a polypeptide having delta-5 desaturase activity comprising a first amino acid motif selected from the group consisting of: SEQ ID NO:9 (HgGG), SEQ ID NO:10 (HhGG), SEQ ID NO:11 (HPGs), SEQ ID NO:12 (HcGG), SEQ ID NO:13 (HwGG) and SEQ ID NO:14 (HaGG), and a second amino acid motif selected from the group consisting of: SEQ ID NO:15 (HDsSH), SEQ ID NO:16 (HDsSH), SEQ ID NO:17 (HDAaH), SEQ ID NO:18 (HDAgH) and SEQ ID NO:19 (HeASH); and, b) a source of substrate fatty acid selected from the group consisting of DGLA and ETA;

wherein the host cell is grown under conditions such that the mutant delta-5 desaturase is expressed and the substrate fatty acid is converted to product PUFA, wherein DGLA is converted to ARA and/or ETA is converted to EPA; and wherein the product PUFA is optionally recovered.

Alternatively, each mutant delta-5 desaturase gene and its corresponding enzyme product described herein can be used indirectly for the production of various omega-6 and omega-3 PUFAs (see FIG. 1; U.S. Pat. No. 7,238,482; U.S. Pat. No. 7,678,560; U.S. Pat. No. 7,695,950). Indirect production of omega-3/omega-6 PUFAs occurs wherein the fatty acid substrate is converted indirectly into the desired fatty acid product, via means of an intermediate step(s) or pathway intermediate(s). Thus, it is contemplated that the mutant delta-5 desaturases described herein may be expressed in conjunction with additional genes encoding enzymes of the PUFA biosynthetic pathway (e.g., delta-6 desaturases, $C_{18/20}$ elongases, delta-17 desaturases, delta-8 desaturases, delta-15 desaturases, delta-9 desaturases, delta-12 desaturases, $C_{14/16}$ elongases, $C_{16/18}$ elongases, delta-9 elongases, delta-5 desaturases, delta-4 desaturases, $C_{20/22}$ elongases) to result in higher levels of production of longer-chain omega-3/omega-6 fatty acids, such as e.g., ARA, EPA, DTA, DPAn-6, DPA and/or DHA.

Preferably, the delta-5 desaturases described herein will be expressed in conjunction with at least a delta-9 elongase and a delta-8 desaturase. The delta-5 desaturases could also be expressed in conjunction with at least a delta-6 desaturase and a delta-6 elongase. However, the particular genes included within a particular expression cassette will depend on the host cell (and its PUFA profile and/or desaturase/elongase profile), the availability of substrate and the desired end product(s).

It is necessary to create and introduce a recombinant construct comprising an ORF encoding a mutant delta-5 desaturase (i.e., wherein said mutant comprises a first amino acid motif selected from the group consisting of: SEQ ID NO:9 (HgGG), SEQ ID NO:10 (HhGG), SEQ ID NO:11 (HPGs), SEQ ID NO:12 (HcGG), SEQ ID NO:13 (HwGG) and SEQ ID NO:14 (HaGG), and a second amino acid motif selected from the group consisting of: SEQ ID NO:15 (HDsSH), SEQ ID NO:16 (HDsSH), SEQ ID NO:17 (HDAaH), SEQ ID NO:18 (HDAgH) and SEQ ID NO:19 (HeASH)) into a suitable host cell.

One of skill in the art is aware of standard resource materials that describe: 1) specific conditions and procedures for construction, manipulation and isolation of macromolecules, such as DNA molecules, plasmids, etc.; 2) generation of recombinant DNA fragments and recombinant expression constructs; and, 3) screening and isolating of clones or plant lines. See, Sambrook et al.; Silhavy et al.; Ausubel et al.; Maliga et al., Methods in Plant Molecular Biology, Cold Spring Harbor: NY (1995); Birren et al., Genome Analysis: Detecting Genes, Vol. 1, Cold Spring Harbor: NY (1998); Birren et al., Genome Analysis: Analyzing DNA, Vol. 2, Cold Spring Harbor: NY (1998); Plant Molecular Biology: A Laboratory Manual, eds. Clark, Springer: NY (1997).

In general, the choice of sequences included in the construct depends on the desired expression products, the nature of the host cell and the proposed means of separating transformed cells versus non-transformed cells. The skilled artisan is aware of the genetic elements that must be present on the plasmid vector to successfully transform, select and propagate host cells containing the chimeric gene. Typically, however, the vector or cassette contains sequences directing transcription and translation of the relevant gene(s), a selectable marker and sequences allowing autonomous replication or chromosomal integration. Suitable expression cassettes typically comprise a promoter, the coding sequence of a selected gene, and a terminator. It is most preferred when both control regions are derived from genes from the transformed host cell.

Promoters useful for driving expression of the instant delta-5 desaturase ORFs in the desired microbial host cell or plant cell are well known. Virtually any promoter (i.e., native, synthetic, or chimeric) capable of directing expression of these genes in the selected host cell is suitable. Expression in a host cell can be accomplished in an induced or constitutive fashion. Induced expression occurs by inducing the activity of a regulatable promoter operably linked to the gene of interest, while constitutive expression occurs by the use of a constitutive promoter.

As an example, U.S. Pat. Pub. No. 2009-0093543-A1 describes promoters for use in *Yarrowia lipolytica*. Any one of a number of promoters can be used, depending upon whether constitutive or induced transcription is desired, the efficiency of the promoter in expressing the ORF of interest, the ease of construction and the like.

Nucleotide sequences surrounding the translational initiation codon 'ATG' have been found to affect expression in yeast cells. If the desired polypeptide is poorly expressed in yeast, the coding region of exogenous genes can be modified to include an efficient yeast translation initiation sequence to obtain optimal gene expression. For expression in yeast, this can be done by site-directed mutagenesis of an inefficiently expressed gene or by fusing it in-frame to an endogenous yeast promoter, preferably a highly expressed promoter. Alternatively, the consensus translation initiation sequence of the host can be engineered into heterologous genes for their optimal expression.

The terminator can be derived from the 3' region of the gene from which the promoter was obtained or from a different gene. A large number of terminators are known and function satisfactorily in a variety of hosts, when utilized both in the same and different genera and species from which they were derived. The terminator usually is selected more as a matter of convenience rather than because of any particular property. Terminators may be derived from various genes native to the preferred hosts. The terminator can also be synthetic, as one of skill in the art can utilize available information to design and synthesize a terminator. A terminator may be unnecessary, but is highly preferred.

Merely inserting a gene into a cloning vector does not ensure its expression at the desired rate, concentration, amount, etc. In response to the need for high level expression, many specialized expression vectors have been created by adjusting certain properties that govern transcription, RNA stability, translation, protein stability and location, as well as secretion from the microbial host cell or plant cell. These properties include: the nature of the relevant transcriptional promoter and terminator sequences; the number of copies of the cloned gene (wherein additional copies may be cloned within a single expression construct and/or additional copies may be introduced into the host cell by increasing the plasmid copy number or by multiple integration of the cloned gene into the genome); whether the gene is plasmid-borne or integrated into the host cell genome; the final cellular location of the synthesized foreign protein; the efficiency of translation and correct folding of the protein in the host organism; the intrinsic stability of the mRNA and protein of the cloned gene within the host cell; and, the codon usage within the cloned gene. Each of these may be used in the methods and host cells described herein, to further optimize expression of the mutant delta-5 desaturases.

After a recombinant construct is created comprising at least one chimeric gene comprising a promoter, a mutant delta-5 desaturase ORF and a terminator, it is placed in a plasmid vector capable of autonomous replication in a host cell, or it is directly integrated into the genome of the host cell. Integration of expression cassettes can occur randomly within the host genome or can be targeted through the use of constructs containing regions of homology with the host genome sufficient to target recombination within the host locus. Where constructs are targeted to an endogenous locus, all or some of the transcriptional and translational regulatory regions can be provided by the endogenous locus.

Where two or more genes are expressed from separate replicating vectors, it is desirable that each vector has a different means of selection and should lack homology to the other construct(s) to maintain stable expression and prevent reassortment of elements among constructs. Judicious choice of regulatory regions, selection means and method of propagation of the introduced construct(s) can be experimentally determined so that all introduced genes are expressed at the necessary levels to provide for synthesis of the desired products.

Constructs comprising the gene(s) of interest may be introduced into a microbial host cell or plant host cell by any standard technique. These techniques include transformation, e.g., lithium acetate transformation (*Methods in Enzymology*, 194:186-187 (1991)), bolistic impact, electroporation, microinjection, or any other method that introduces the gene(s) of interest into the host cell.

For convenience, a host cell that has been manipulated by any method to take up a DNA sequence, for example, in an expression cassette, is referred to herein as "transformed", "transformant" or "recombinant". The transformed host will have at least one copy of the expression construct and may have two or more, depending upon whether the expression cassette is integrated into the genome, amplified, or is present on an extrachromosomal element having multiple copy numbers. The transformed host cell can be identified by selection for a marker contained on the introduced construct. Alternatively, a separate marker construct may be co-transformed with the desired construct, as many transformation techniques introduce many DNA molecules into host cells.

Typically, transformed hosts are selected for their ability to grow on selective media, which may incorporate an antibiotic or lack a factor necessary for growth of the untransformed host, such as a nutrient or growth factor. An introduced marker gene may confer antibiotic resistance, or encode an essential growth factor or enzyme, thereby permitting growth on selective media when expressed in the transformed host. Selection of a transformed host can also occur when the expressed marker can be detected, either directly or indirectly. Additional selection techniques are described in U.S. Pat. No. 7,238,482, U.S. Pat. No. 7,259,255 and U.S. Pat. No. 7,932,077.

Following transformation, substrates suitable for the instant mutant delta-5 desaturases (and, optionally, other PUFA enzymes that are co-expressed within the host cell) may be produced by the host either naturally or transgenically, or they may be provided exogenously.

A variety of eukaryotic organisms are suitable as host, to thereby yield a transformant comprising mutant delta-5 desaturases as described herein, including bacteria, yeast, algae, stramenopiles, oomycetes, euglenoids, fungi and/or plants. This is contemplated because transcription, translation and the protein biosynthetic apparatus are highly conserved. Thus, suitable hosts may include, but are not limited to, those that grow on a variety of feedstocks, including simple or complex carbohydrates, fatty acids, organic acids, oils, glycerols and alcohols, and/or hydrocarbons over a wide range of temperature and pH values.

Preferred microbial hosts are oleaginous organisms. These oleaginous organisms are naturally capable of oil synthesis and accumulation, wherein the total oil content can comprise greater than about 25% of the dry cell weight ["DCW"], more preferably greater than about 30% of the DCW, more preferably greater than about 40% of the DCW, more preferably greater than about 50% of the DCW, and most preferably greater than about 60% of the DCW. Various bacteria, algae, euglenoids, moss, fungi, yeast and stramenopiles are naturally classified as oleaginous. In alternate embodiments, a non-oleaginous organism can be genetically modified to become oleaginous, e.g., yeast such as *Saccharomyces cerevisiae* (see, Intl App. Pub. No. WO 2006/102342).

In more preferred embodiments, the microbial host cells are oleaginous yeast capable of producing at least 25% of the DCW as oil. Genera typically identified as oleaginous yeast include, but are not limited to: *Yarrowia, Candida, Rhodotorula, Rhodosporidium, Cryptococcus, Trichosporon* and *Lipomyces*. More specifically, illustrative oil-synthesizing yeasts include: *Rhodosporidium toruloides, Lipomyces starkeyii, L. lipoferus, Candida revkaufi, C. pulcherrima, C. tropicalis, C. utilis, Trichosporon pullans, T. cutaneum, Rhodotorula glutinus, R. graminis*, and *Yarrowia lipolytica*.

Most preferred is the oleaginous yeast *Yarrowia lipolytica*. In a further embodiment, most preferred are the *Y. lipolytica* strains designated as ATCC #20362, ATCC #8862, ATCC #18944, ATCC #76982 and/or LGAM S(7)1 (Papanikolaou S., and Aggelis G., *Bioresour. Technol.*, 82(1):43-9 (2002)).

Specific teachings applicable for transformation of oleaginous yeasts (e.g., *Yarrowia lipolytica*) include U.S. Pat. No. 4,880,741 and U.S. Pat. No. 5,071,764 and Chen, D. C. et al. (*Appl. Microbiol. Biotechnol.*, 48(2):232-235 (1997)). Specific teachings applicable for engineering ARA, EPA and DHA production in *Y. lipolytica* are provided in U.S. Pat. No. 7,588,931, U.S. Pat. Appl. Publications No. 2009-0093543-A1 and No. 2010-0317072-A1 and U.S. Pat. No. 7,550,286, respectively.

The preferred method of expressing genes in this yeast is by integration of linear DNA into the genome of the host. Integration into multiple locations within the genome can be particularly useful when high level expression of genes is desired, such as into the following gene loci: Ura3, Leu2, Lys5, Aco2, Pox3, Lip1, Lip2, SCP2, Pex3, Pex16 and/or Pex10 (see, e.g., U.S. Pat. Appl. Publications No. 2009-0093543-A1 and No. 2010-0317072-A1).

Preferred selection methods for use in *Yarrowia lipolytica* are resistance to kanamycin, hygromycin and the amino glycoside G418, as well as ability to grow on media lacking uracil, leucine, lysine, tryptophan or histidine. 5-fluoroorotic acid (5-fluorouracil-6-carboxylic acid monohydrate; "5-FOA") may also be especially useful for the selection of yeast Ura⁻ mutants (U.S. Pat. Appl. Pub. No. 2009-0093543-A1), or a native acetohydroxyacid synthase (or acetolactate synthase; E.C. 4.1.3.18) that confers sulfonyl urea herbicide resistance (U.S. Pat. No. 7,932,077) may be utilized for selection of transformants. A unique method of "recycling" a pair of preferred selection markers for their use in multiple sequential transformations, by use of site-specific recombinase systems, is also taught in U.S. Pat. Appl. Pub. No. 2009-0093543-A1.

Based on the above, disclosed herein is a method of producing either ARA or EPA, respectively, comprising:
   (a) providing an oleaginous yeast (e.g., *Yarrowia lipolytica*) comprising:
      (i) a first recombinant nucleotide molecule encoding a mutant delta-5 desaturase polypeptide, operably linked to at least one regulatory sequence; and,
      (ii) a source of desaturase substrate consisting of DGLA and/or ETA, respectively; and,
   (b) growing the yeast of step (a) in the presence of a suitable fermentable carbon source wherein the gene encoding the mutant delta-5 desaturase polypeptide is expressed and DGLA is converted to ARA and/or ETA is converted to EPA, respectively; and,
   (c) optionally recovering the ARA and/or EPA, respectively, of step (b).

Substrate feeding may be required. In preferred embodiments, the mutant delta-5 desaturase polypeptide is selected from the group consisting of: SEQ ID NO:139 [EgD5R*-34g157g], SEQ ID NO:141 [EgD5R*-34g158a], SEQ ID NO:143 [EgD5R*-34g158g], SEQ ID NO:145 [EgD5R*-34h158a], SEQ ID NO:147 [EgD5R*-34h158g], SEQ ID NO:149 [EgD5R*-36s158a], SEQ ID NO:151 [EgD5R*-36s158g], SEQ ID NO:153 [EgD5M, codon-optimized EgD5R*-34g158g], SEQ ID NO:157 [EgD5M1, codon-optimized EgD5R*-34g158g347s], SEQ ID NO:181 [EgD5S-36s156e], SEQ ID NO:183 [EgD5S-36s157g], SEQ ID NO:185 [EgD5S-36s158a], SEQ ID NO:187 [EgD5S-36s158g], SEQ ID NO:213 [EaD5S-35a158g], SEQ ID NO:215 [EaD5S-35a158s], SEQ ID NO:217 [EaD5S-35a159g], SEQ ID NO:255 [EgD5R-34g158g], SEQ ID NO:260 [EgD5R-34g158a], SEQ ID NO:271 [EaD5-35g159g], and SEQ ID NO:276 [EaD5-35g159a]. Thus, for example, the nucleotide sequence of the gene encoding the mutant delta-5 desaturase polypeptide may be, for example, selected from the group consisting of: SEQ ID NOs:138, 140, 142, 144, 146, 148, 150, 152, 156, 180, 182, 184, 186, 212, 214, 216, 254, 259, 270 and 275.

Since naturally produced PUFAs in oleaginous yeast are limited to 18:2 fatty acids (i.e., LA), and less commonly, 18:3 fatty acids (i.e., ALA), the oleaginous yeast may be genetically engineered to express multiple enzymes necessary for long-chain PUFA biosynthesis (thereby enabling production of e.g., DPAn-6, DPA and DHA), in addition to the mutant delta-5 desaturases described herein.

Specifically, an oleaginous yeast is contemplated herein, wherein said yeast comprises:

a) a first recombinant DNA construct comprising an isolated polynucleotide encoding a mutant delta-5 desaturase polypeptide, operably linked to at least one regulatory sequence; and, b) at least one additional recombinant DNA construct comprising an isolated polynucleotide, operably linked to at least one regulatory sequence, encoding a polypeptide selected from the group consisting of: delta-4 desaturase, delta-6 desaturase, delta-9 desaturase, delta-12 desaturase, delta-15 desaturase, delta-17 desaturase, delta-8 desaturase, delta-9 elongase, $C_{14/16}$ elongase, $C_{16/18}$ elongase, $C_{18/20}$ elongase and $C_{20/22}$ elongase.

Other suitable microbial hosts include oleaginous bacteria, algae, euglenoids, stramenopiles, oomycetes and fungi. Within this broad group of microbial hosts, of particular interest are microorganisms that synthesize omega-3/omega-6 fatty acids, or those that can be genetically engineered for this purpose. Thus, for example, transformation of *Mortierella alpina* (which is commercially used for production of ARA) with any of the present delta-5 desaturase genes under the control of inducible or regulated promoters could yield a transformant organism capable of synthesizing increased quantities of ARA. The method of transformation of *M. alpina* is described by Mackenzie et al. (Appl. Environ. Microbiol., 66:4655 (2000)). Similarly, methods for transformation of Thraustochytriales microorganisms (e.g., *Thraustochytrium, Schizochytrium*) are disclosed in U.S. Pat. No. 7,001,772.

The delta-5 desaturase genes and gene products described herein may also be produced in cells within heterologous oleaginous plants, which are commonly referred to as "oilseed" plants. Examples of oilseed plants include, but are not limited to: soybean (Glycine and *Soja* sp.), flax (*Linum* sp.), rapeseed (*Brassica* sp.), maize, cotton, safflower (*Carthamus* sp.) and sunflower (*Helianthus* sp.).

In one embodiment, this invention concerns a recombinant construct comprising any one of the delta-5 desaturase polynucleotides of the invention operably linked to at least one regulatory sequence suitable for expression in a plant.

The plant promoter chosen to drive expression of the delta-5 desaturase coding sequence is not important as long as it has sufficient transcriptional activity to accomplish the invention by expressing translatable mRNA for the desired nucleic acid fragments in the desired host tissue at the right time. Either heterologous or non-heterologous (i.e., endogenous) promoters can be used to practice the invention. For example, suitable promoters include, but are not limited to: the alpha-prime subunit of 13-conglycinin promoter, the Kunitz trypsin inhibitor 3 promoter, the annexin promoter (also known as the P34 promoter; Intl App. Pub. No. WO 2004/071178), the Glyl promoter, the 13 subunit of 13-conglycinin promoter, the P34/Gly Bd m 30K promoter, the albumin promoter, the Leg A1 promoter and the Leg A2 promoter.

The promoter is then operably linked in a sense orientation using conventional means well known to those skilled in the art.

The recombinant construct may then be introduced into one or more plant cells of choice by methods well known to those of ordinary skill in the art (e.g., transfection, transformation and electroporation). The transformed plant cell is then cultured and regenerated under suitable conditions permitting expression of the long-chain PUFA, which is then optionally recovered and purified.

Either transient or stable expression of at least one desired long-chain PUFA in a plant cell, may be accomplished as is described above. Such PUFAs can also be expressed in seeds, plant parts obtained from transformed plants or oil obtained from seeds of transformed plants.

Plant parts include differentiated and undifferentiated tissues including, but not limited to: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or a group of tissues that constitute a morphologically and functionally distinct part of a plant.

Thus, this invention also concerns a method for transforming a cell, comprising transforming a cell with a recombinant construct of the invention and selecting those cells transformed with the recombinant construct, wherein: said recombinant construct comprises a nucleotide sequence encoding a mutant polypeptide having delta-5 desaturase activity, wherein the amino acid sequence of the mutant polypeptide comprises an amino acid motif as set forth in SEQ ID NO:34 [HxGx], wherein SEQ ID NO:34 [HxGx] is not identical to SEQ ID NO:7 [HPGG]; and, an amino acid motif as set forth in SEQ ID NO:1 [HxxxH], wherein SEQ ID NO:1 [HxxxH] is not identical to SEQ ID NO:8 [HDASH].

Also of interest is a method for producing a transformed plant cell with the mutant delta-5 desaturase polynucleotides of the instant invention and regenerating a plant from the transformed plant cell.

Methods for transforming dicots (primarily by use of *Agrobacterium tumefaciens*) and obtaining transgenic plants have been published, among others, for: cotton (U.S. Pat. No. 5,004,863; U.S. Pat. No. 5,159,135); soybean (U.S. Pat. No. 5,569,834; U.S. Pat. No. 5,416,011); *Brassica* (U.S. Pat. No. 5,463,174); peanut (Cheng et al., *Plant Cell Rep.*, 15:653-657 (1996); McKently et al., *Plant Cell Rep.*, 14:699-703 (1995)); papaya (Ling, K. et al., *Bio/technology*, 9:752-758 (1991)); and pea (Grant et al., *Plant Cell Rep.*, 15:254-258 (1995)). For a review of other commonly used methods of plant transformation see Newell, C. A. (*Mol. Biotechnol.*, 16:53-65 (2000)). One of these methods of transformation uses *Agro-* bacterium rhizogenes (Tepfler, M. and Casse-Delbart, F., *Microbiol. Sci.*, 4:24-28 (1987)). Transformation of soybeans using direct delivery of DNA has been published using PEG fusion (Intl App. Pub. No. WO 92/17598), electroporation (Chowrira, G. M. et al., *Mol. Biotechnol.*, 3:17-23 (1995); Christou, P. et al., *Proc. Natl. Acad. Sci. Sci. USA*, 84:3962-3966 (1987)), microinjection, or particle bombardment (McCabe, D. E. et al., *Bio/Technology*, 6:923 (1988); Christou et al., *Plant Physiol.*, 87:671-674 (1988)).

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well known in the art (Weissbach and Weissbach, In: Methods for Plant Molecular Biology, (Eds.), Academic: San Diego, Calif. (1988)). This regeneration and growth process typically includes the steps of selection of transformed cells and culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

In one embodiment this invention concerns an oilseed plant comprising:
 a) a first recombinant DNA construct comprising an isolated polynucleotide encoding a mutant polypeptide having delta-5 desaturase activity, operably linked to at least one regulatory sequence; and,
 b) at least one additional recombinant DNA construct comprising an isolated polynucleotide, operably linked to at least one regulatory sequence, encoding a polypeptide selected from the group consisting of: a delta-4 desaturase, a delta-5 desaturase, delta-6 desaturase, a delta-9 desaturase, a delta-12 desaturase, a delta-15 desaturase, a delta-17 desaturase, a delta-9 elongase, a $C_{14/16}$ elongase, a $C_{16/18}$ elongase, a $C_{18/20}$ elongase and a $C_{20/22}$ elongase.

Such additional desaturases and elongase are discussed in numerous references in patent and public literature (e.g., U.S. Pat. No. 6,075,183, U.S. Pat. No. 5,968,809, U.S. Pat. No. 6,136,574, U.S. Pat. No. 5,972,664, U.S. Pat. No. 6,051,754, No. 6,410,288, U.S. Pat. No. 7,932,077 and Intl App. Pub. No. WO 98/46763, No. WO 98/46764, No. WO 00/12720, No. WO 00/40705).

The choice of combination of cassettes used depends in part on the PUFA profile and/or desaturase/elongase profile of the oilseed plant cells to be transformed and the long-chain PUFA(s) which is to be expressed.

In another aspect, this invention concerns a method for making long-chain PUFAs in a plant cell comprising:
 a) transforming a cell with a recombinant construct of the invention; and,
 b) selecting those transformed cells that make long-chain PUFAs.

In still another aspect, this invention concerns a method for producing at least one PUFA in a plant cell comprising:

(a) transforming a plant cell with a first recombinant DNA construct comprising:
  i. an isolated polynucleotide encoding a mutant polypeptide having delta-5 desaturase activity, operably linked to at least one regulatory sequence; and,
  ii. at least one additional recombinant DNA construct comprising an isolated polynucleotide, operably linked to at least one regulatory sequence, encoding a polypeptide selected from the group consisting of: a delta-4 desaturase, a delta-5 desaturase, delta-6 desaturase, a delta-9 desaturase, a delta-12 desaturase, a delta-15 desaturase, a delta-17 desaturase, a delta-9 elongase, a $C_{14/16}$ elongase, a $C_{16/18}$ elongase, a $C_{18/20}$ elongase and a $C_{20/22}$ elongase;
 (b) regenerating a plant from the transformed cell of step (a); and,
 (c) selecting those seeds obtained from the plants of step (b) having an altered level of PUFAs when compared to the level in seeds obtained from a nontransformed plant.

In particularly preferred embodiments, the at least one additional recombinant DNA construct encodes polypeptides having delta-9 elongase activity and delta-8 desaturase activity.

Irrespective of the host selected for expression of the mutant delta-5 desaturases described herein, multiple transformants must be screened in order to obtain a strain or plant line displaying the desired expression level and pattern. For example, Juretzek et al. (Yeast, 18:97-113 (2001)) note that the stability of an integrated DNA fragment in *Yarrowia lipolytica* is dependent on the individual transformants, the recipient strain and the targeting platform used. Such screening may be accomplished by Southern analysis of DNA blots (Southern, *J. Mol. Biol.*, 98:503 (1975)), Northern analysis of mRNA expression (Kroczek, *J. Chromatogr. Biomed. Appl.*, 618(1-2):133-145 (1993)), Western and/or Elisa analyses of protein expression, phenotypic analysis or GC analysis of the PUFA products.

Knowledge of the sequences of the present mutant delta-5 desaturases will be useful for manipulating omega-3 and/or omega-6 fatty acid biosynthesis in various host cells. Methods for manipulating biochemical pathways are well known to those skilled in the art and it is expected that numerous manipulations will be possible to maximize omega-3 and/or omega-6 fatty acid biosynthesis in oleaginous yeasts, particularly in *Yarrowia lipolytica*, and oilseed plants. This manipulation may require metabolic engineering directly within the PUFA biosynthetic pathway or additional manipulation of pathways that contribute carbon to the PUFA biosynthetic pathway. Methods useful for up-regulating desirable biochemical pathways and down-regulating undesirable biochemical pathways are well known to those skilled in the art.

For example, biochemical pathways competing with the omega-3 and/or omega-6 fatty acid biosynthetic pathways for energy or carbon, or native PUFA biosynthetic pathway enzymes that interfere with production of a particular PUFA end-product, may be eliminated by gene disruption or down-regulated by other means, e.g., antisense mRNA.

Detailed discussion of manipulations within the PUFA biosynthetic pathway as a means to increase ARA, EPA or DHA and associated techniques thereof are presented in U.S. Pat. No. 7,588,931, U.S. Pat. No. 7,932,077, U.S. Pat. Appl. Pub. No. 2009-0993543-A1, and U.S. Pat. No. 7,550,286, respectively, as are desirable manipulations in the TAG biosynthetic pathway and the TAG degradation pathway (and associated techniques thereof).

It may be useful to modulate the expression of the fatty acid biosynthetic pathway by any one of the strategies described above. For example, provided herein are methods whereby genes encoding key enzymes in the delta-9 elongase/delta-8 desaturase biosynthetic pathway and delta-6 desaturase/delta-6 elongase biosynthetic pathway are introduced into oleaginous yeasts or oilseed plants for the production of omega-3 and/or omega-6 fatty acids. It will be particularly useful to express the present mutant delta-5 desaturase genes in oleaginous yeasts or oilseed plants that do not naturally possess omega-3 and/or omega-6 fatty acid biosynthetic pathways and coordinate the expression of these genes, to maximize production of preferred PUFA products using various means for metabolic engineering of the host organism.

The transformed microbial host cell is grown under conditions that optimize expression of chimeric genes (e.g., desaturase, elongase) and produce the greatest and most economical yield of desired PUFAs. In general, media conditions that may be optimized include the type and amount of carbon source, the type and amount of nitrogen source, the carbon-to-nitrogen ratio, the amount of different mineral ions, the oxygen level, growth temperature, pH, length of the biomass production phase, length of the oil accumulation phase and the time and method of cell harvest. Microorganisms of interest, such as oleaginous yeast (e.g., *Yarrowia lipolytica*), are generally grown in a complex medium such as yeast extract-peptone-dextrose broth ["YPD"] or a defined minimal media that lacks a component necessary for growth and thereby forces selection of the desired expression cassettes (e.g., Yeast Nitrogen Base (DIFCO Laboratories, Detroit, Mich.)).

Fermentation media for the methods and host cells described herein must contain a suitable carbon source such as are taught in U.S. Pat. No. 7,238,482 and U.S. Pat. Pub. No. 2011-0059204-A1. Although it is contemplated that the source of carbon utilized in the methods herein may encompass a wide variety of carbon-containing sources, preferred carbon sources are sugars (e.g., glucose, invert sucrose, fructose and combinations of thereof), glycerols, and/or fatty acids.

Nitrogen may be supplied from an inorganic (e.g., $(NH_4)_2SO_4$) or organic (e.g., urea or glutamate or "yeast extract") source. In addition to appropriate carbon and nitrogen sources, the fermentation media must also contain suitable minerals, salts, cofactors, buffers, vitamins and other components known to those skilled in the art suitable for the growth of the oleaginous host and promotion of the enzymatic pathways necessary for PUFA production. Particular attention is given to several metal ions, such as $Fe^{+2}$, $Cu^{+2}$, $Mn^{+2}$, $Co^{+2}$, $Zn^{+2}$ and $Mg^{+2}$, that promote synthesis of lipids and PUFAs (Nakahara, T. et al., *Ind. Appl. Single Cell Oils*, D. J. Kyle and R. Colin, eds. pp 61-97 (1992)).

Preferred growth media for the methods and host cells described herein are common commercially prepared media, such as Yeast Nitrogen Base (DIFCO Laboratories, Detroit, Mich.). Other defined or synthetic growth media may also be used and the appropriate medium for growth of the transformant host cells will be known by one skilled in the art of microbiology or fermentation science. A suitable pH range for the fermentation is typically between about pH 4.0 to pH 8.0, wherein pH 5.5 to pH 7.5 is preferred as the range for the initial growth conditions. The fermentation may be conducted under aerobic or anaerobic conditions, wherein microaerobic conditions are preferred.

Typically, accumulation of high levels of PUFAs in oleaginous yeast cells requires a two-stage process, since the metabolic state must be "balanced" between growth and synthesis/storage of fats. Thus, most preferably, a two-stage fermentation process is necessary for the production of PUFAs in oleaginous yeast (e.g., *Yarrowia lipolytica*). This approach is described in U.S. Pat. No. 7,238,482, as are various suitable fermentation process designs (i.e., batch, fed-batch and continuous) and considerations during growth.

PUFAs may be found in host microorganisms as free fatty acids or in esterified forms such as acylglycerols, phospholipids, sulfolipids or glycolipids, and may be extracted from the host cells through a variety of means well-known in the art. One review of extraction techniques, quality analysis and acceptability standards for yeast lipids is that of Z. Jacobs (*Critical Reviews in Biotechnology*, 12(5/6):463-491 (1992)). A brief review of downstream processing is also available by A. Singh and O. Ward (*Adv. Appl. Microbiol.*, 45:271-312 (1997)).

In general, means for the purification of PUFAs may include extraction (e.g., U.S. Pat. No. 6,797,303 and U.S. Pat. No. 5,648,564) with organic solvents, sonication, supercritical fluid extraction (e.g., using carbon dioxide), saponification and physical means such as presses, or combinations thereof. See U.S. Pat. No. 7,238,482 for additional details.

There are a plethora of food and feed products incorporating omega-3 and/or omega-6 fatty acids, particularly e.g., ALA, GLA, ARA, EPA, DPA and DHA. It is contemplated that the microbial or plant biomass comprising long-chain PUFAs, partially purified biomass comprising PUFAs, purified oil comprising PUFAs, and/or purified PUFAs will function in food and feed products to impart the health benefits of current formulations. More specifically, oils containing omega-3 and/or omega-6 fatty acids will be suitable for use in a variety of food and feed products including, but not limited to: food analogs, meat products, cereal products, baked foods, snack foods and dairy products (see e.g., U.S. Pat. No. 7,588,931).

The present compositions may be used in formulations to impart health benefit in medical foods including medical nutritionals, dietary supplements, infant formula and pharmaceuticals. One of skill in the art of food processing and food formulation will understand how the amount and composition of the present oils may be added to the food or feed product. Such an amount will be referred to herein as an "effective" amount and will depend on the food or feed product, the diet that the product is intended to supplement or the medical condition that the medical food or medical nutritional is intended to correct or treat.

The present compositions may also be used to improve animal's health; they may be used in animal food, feed and pharmaceuticals.

EXAMPLES

The present invention is further described in the following Examples, which illustrate reductions to practice of the invention but do not completely define all of its possible variations.
General Methods Standard recombinant DNA and molecular cloning techniques used in the Examples are well known in the art and are described by:
1) Sambrook et al.; 2) Silhavy et al.; and, 3) Ausubel et al.

Materials and Methods suitable for the maintenance and growth of microbial cultures are well known in the art. Techniques suitable for use in the following examples may be found as set out in Manual of Methods for General Bacteriology (Phillipp Gerhardt, R. G. E. Murray, Ralph N. Costilow, Eugene W. Nester, Willis A. Wood, Noel R. Krieg and G. Briggs Phillips, Eds), American Society for Microbiology: Washington, D.C. (1994)); or by Thomas D. Brock in Biotechnology: A Textbook of Industrial Microbiology, 2nd ed., Sinauer Associates: Sunderland, Mass. (1989). All reagents, restriction enzymes and materials used for the growth and maintenance of microbial cells were obtained from Aldrich Chemicals (Milwaukee, Wis.), DIFCO Laboratories (Detroit, Mich.), GIBCO/BRL (Gaithersburg, Md.), or Sigma Chemical Company (St. Louis, Mo.), unless otherwise specified. *E. coli* strains were typically grown at 37° C. on Luria Bertani ["LB"] plates.

General molecular cloning was performed according to standard methods (Sambrook et al., supra). DNA sequence was generated on an ABI Automatic sequencer using dye terminator technology (U.S. Pat. No. 5,366,860; EP 272,007) using a combination of vector and insert-specific primers. Sequence editing was performed in Sequencher (Gene Codes Corporation, Ann Arbor, Mich.). All sequences represent coverage at least two times in both directions. Comparisons of genetic sequences were accomplished using DNASTAR software (DNASTAR Inc., Madison, Wis.).

The meaning of abbreviations is as follows: "sec" means second(s), "min" means minute(s), "h" or "hr" means hour(s), "d" means day(s), "μL" means microliter(s), "mL" means milliliter(s), "L" means liter(s), "μM" means micromolar, "mM" means millimolar, "M" means molar, "mmol" means millimole(s), "μmole" mean micromole(s), "g" means gram(s), "μg" means microgram(s), "ng" means nanogram(s), "U" means unit(s), "bp" means base pair(s) and "kB" means kilobase(s).

Nomenclature for Expression Cassettes:

The structure of an expression cassette will be represented by a simple notation system of "X::Y::Z", wherein X describes the promoter fragment, Y describes the gene fragment, and Z describes the terminator fragment, which are all operably linked to one another.

Transformation and Cultivation of *Yarrowia lipolytica*:

*Y. lipolytica* strains with ATCC Accession Nos. #20362, #76982 and #90812 were purchased from the American Type Culture Collection (Rockville, Md.). *Y. lipolytica* strains were typically grown at 28-30° C. in several media, according to the recipes shown below. Agar plates were prepared as required by addition of 20 g/L agar to each liquid media, according to standard methodology.

YPD agar medium (per liter): 10 g of yeast extract [Difco]; 20 g of Bacto peptone [Difco]; and 20 g of glucose.

Basic Minimal Media (MM) (per liter): 20g glucose; 1.7 g yeast nitrogen base without amino acids; 1.0 g proline; and pH 6.1 (not adjusted).

Minimal Media+Leucine (MM+leucine or MMLeu) (per liter): Prepare MM media as above and add 0.1 g leucine.

High Glucose Media (HGM) (per liter): 80 glucose; 2.58 g $KH_2PO_4$; and 5.36 g $K_2HPO_4$; pH 7.5 (do not need to adjust).

Transformation of *Y. lipolytica* was performed as described in U.S. Pat. Appl. Pub. No. 2009-0093543-A1, hereby incorporated herein by reference.

Fatty Acid Analysis of *Yarrowia lipolytica*:

For fatty acid analysis, cells were collected by centrifugation and lipids were extracted as described in Bligh, E. G. & Dyer, W. J. (*Can. J. Biochem. Physiol.*, 37:911-917 (1959)). FAMEs were prepared by transesterification of the lipid extract with sodium methoxide (Roughan, G. and Nishida I., *Arch Biochem Biophys.*, 276(1):38-46 (1990)) and subsequently analyzed with a Hewlett-Packard 6890 GC fitted with a 30 m×0.25 mm (i.d.) HP-INNOWAX (Hewlett-Packard) column. The oven temperature was from 170° C. (25 min hold) to 185° C. at 3.5° C./min.

For direct base transesterification, *Yarrowia* culture (3 mL) was harvested, washed once in distilled water, and dried under vacuum in a Speed-Vac for 5-10 min. Sodium methoxide (100 μL of 1%) was added to the sample, and then the sample was vortexed and rocked for 20 min. After adding 3 drops of 1 M NaCl and 400 μL hexane, the sample was vortexed and spun. The upper layer was removed and analyzed by GC as described above.

Alternately, a modification of the base-catalysed transersterification method described in *Lipid Analysis*, William W. Christie, 2003 was used for routine analysis of the broth samples from either fermentation or flask samples. Specifically, broth samples were rapidly thawed in room temperature water, then weighed (to 0.1 mg) into a tarred 2 mL microcentrifuge tube with a 0.22 μm Corning® Costar® Spin-X® centrifuge tube filter (Cat. No. 8161). Sample (75-800 μl) was used, depending on the previously determined DCW. Using an Eppendorf 5430 centrifuge, samples are centrifuged for 5-7 min at 14,000 rpm or as long as necessary to remove the broth. The filter was removed, liquid was drained, and ~500 μl of deionized water was added to the filter to wash the sample. After centrifugation to remove the water, the filter was again removed, the liquid drained and the filter re-inserted. The tube was then re-inserted into the centrifuge, this time with the top open, for ~3-5 min to dry. The filter was then cut approximately ½ way up the tube and inserted into a fresh 2 mL round bottom Eppendorf tube (Cat. No. 22 36 335-2). The filter was pressed to the bottom of the tube with an appropriate tool that only touches the rim of the cut filter container and not the sample or filter material. A known amount of C15:0 TAG (supra) in toluene was added and 500 μl of freshly made 1% sodium methoxide in methanol solution. The sample pellet was firmly broken up with the appropriate tool and the tubes were closed and placed in a 50° C. heat block (VWR Cat. No. 12621-088) for 30 min. The tubes were then allowed to cool for at least 5 min. Then, 400 μl of hexane and 500 μl of a 1 M NaCl in water solution were added, the tubes were vortexed for 2×6 sec and centrifuged for 1 min. Approximately 150 μl of the top (organic) layer was placed into a GC vial with an insert and analyzed by GC.

Construction Of *Yarrowia lipolytica* Strain Y4036U

*Y. lipolytica* strain Y4036U (Leu–, Ura–), described in Int'l App. Pub. No. WO 2008/073367, was used as the host in Examples 3-5, 7-8 and 10, infra.

Strain Y4036U was derived from *Y. lipolytica* ATCC #20362 via construction of strain Y2224 (Ura3–, a FOA resistant mutant from an autonomous mutation of the Ura3 gene), strain Y4001 (producing 17% EDA with a Leu– phenotype), strain Y4001U1 (Leu– and Ura–) and strain Y4036 (producing 18% DGLA with a Leu– phenotype).

The final genotype of strain Y4036U with respect to wild type *Y. lipolytica* ATCC #20362 was Ura3–, YAT1::ME3S::Pex16, EXP1::EgD9eS::Lip1, FBAINm:EgD9eS:Lip2, GPAT:EgD9e:Lip2, FBAINm:EgD8M:Pex20, EXP1:EgD8M:Pex16, GPD:FmD12:Pex20, YAT1:FmD12:OCT (wherein FmD12 is a *Fusarium moniliforme* delta-12 desaturase gene [U.S. Pat. No. 7,504,259]; MESS is a codon-optimized $C_{16/18}$ elongase gene, derived from *Mortierella* alpina [U.S. Pat. No. 7,470,532]; EgD9e is a *Euglena gracilis* delta-9 elongase gene [U.S. Pat. No. 7,645,604]; EgD9eS is a codon-optimized delta-9 elongase gene, derived from *E. gracilis* [U.S. Pat. No. 7,645,604]; and, EgD8M is a synthetic mutant delta-8 desaturase [U.S. Pat. No. 7,709,239], derived from *E. gracilis* [U.S. Pat. No. 7,256,033]).

Example 1

Development of a Topological Model for the *Euglena gracilis* Delta-5 Desaturase ["EgD5"]

In order to better predict the possible importance of the HDASH motif within the delta-5 desaturase from *E. gracilis*

["EgD5"; U.S. Pat. No. 7,678,560], a topological model (FIG. 2) was developed based on the logic and analyses below.

First, an analysis of transmembrane domains of EgD5 was performed using the TMHMM program ("Prediction of transmembrane helices in proteins"; TMHMM Server v. 2.0, Center for Biological Sequence Analysis, BioCentrum-DTU, Technical University of Denmark, DK-2800 Lyngby, Denmark). The prediction indicated six membrane-spanning helices (amino acid residues 103-125, 130-152, 165-187, 234-256, 280-302 and 306-328), with both the N- and C-termini located on the cytoplasmic side of the membrane.

A similar TMHMM analysis was performed using the following homologs of EgD5: GenBank Accession No. AAT09160 [*Nitzchia closterium f. minutissima*], GenBank Accession No. BAG71007 [0 blongichytrium sp. SEK 347], and GenBank Accession No. AAL92562 [*Phaeodactylum tricornutum*]. For each homolog, four transmembrane segments were predicted, which corresponded to the first two and the last two transmembrane domains predicted for EgD5.

The membrane-bound fatty acid desaturases belong to a superfamily of membrane di-iron proteins that feature three histidine-rich (His-rich) motifs: $HX_{(3-4)}H$ (SEQ ID NOs:1 and 2), $HX_{(2-3)}HH$ (SEQ ID NOs:3 and 4) and $(H/Q)X_{(2-3)}HH$ (SEQ ID NOs:5 and 6). These His-rich residues have been predicted to be located in the cytoplasmic face of the membrane and have been shown to be important for enzyme activity (Shanklin, J. et al., *Biochemistry*, 33:12787-12794 (1994); Shanklin, J., and Cahoon, E. B., *Annu. Rev. Plant Physiol. Plant Mol. Biol.*, 49:611-641 (1998)). Within EgD5, the first His-rich region (HDASH [SEQ ID NO:8]) is located before the third predicted transmembrane segment spanning amino acid residues 165-187, while the second His-rich region (HIMRHH [SEQ ID NO:4]) is located after this transmembrane segment. If the third transmembrane segment indeed spans the membrane, then the second His-rich region would be located in the periplasmic space—thus preventing its participation in the iron-active site. As a result, it was hypothesized that neither the third transmembrane segment (amino acid residues 165-187) nor the fourth transmembrane segment (amino acid residues 234-256) were membrane spanning. This was consistent with the TMHMM predictions for the three delta-5 desaturase homologs (i.e., GenBank Accession No. AAT09160, No. BAG71007 and No. AAL92562).

Because the delta-5 desaturase substrate (i.e., DGLA, ETA) is highly hydrophobic, it was assumed to likely partition in the lipid bilayer. Similarly, it was assumed that the active site assembled from the three His-rich clusters would likely occur at or very near the membrane surface. Thus, the third and fourth transmembrane segments found between residues 165-187 and 234-256, respectively, that were originally predicted by TMHMM to span through the membrane were instead predicted to lie near the membrane surface to ensure that the active site was positioned close to the membrane. The transmembrane regions at amino acid residues 103-125, 130-152, 280-302 and 306-328 remained as predicted by TMHMM.

Figure 2:
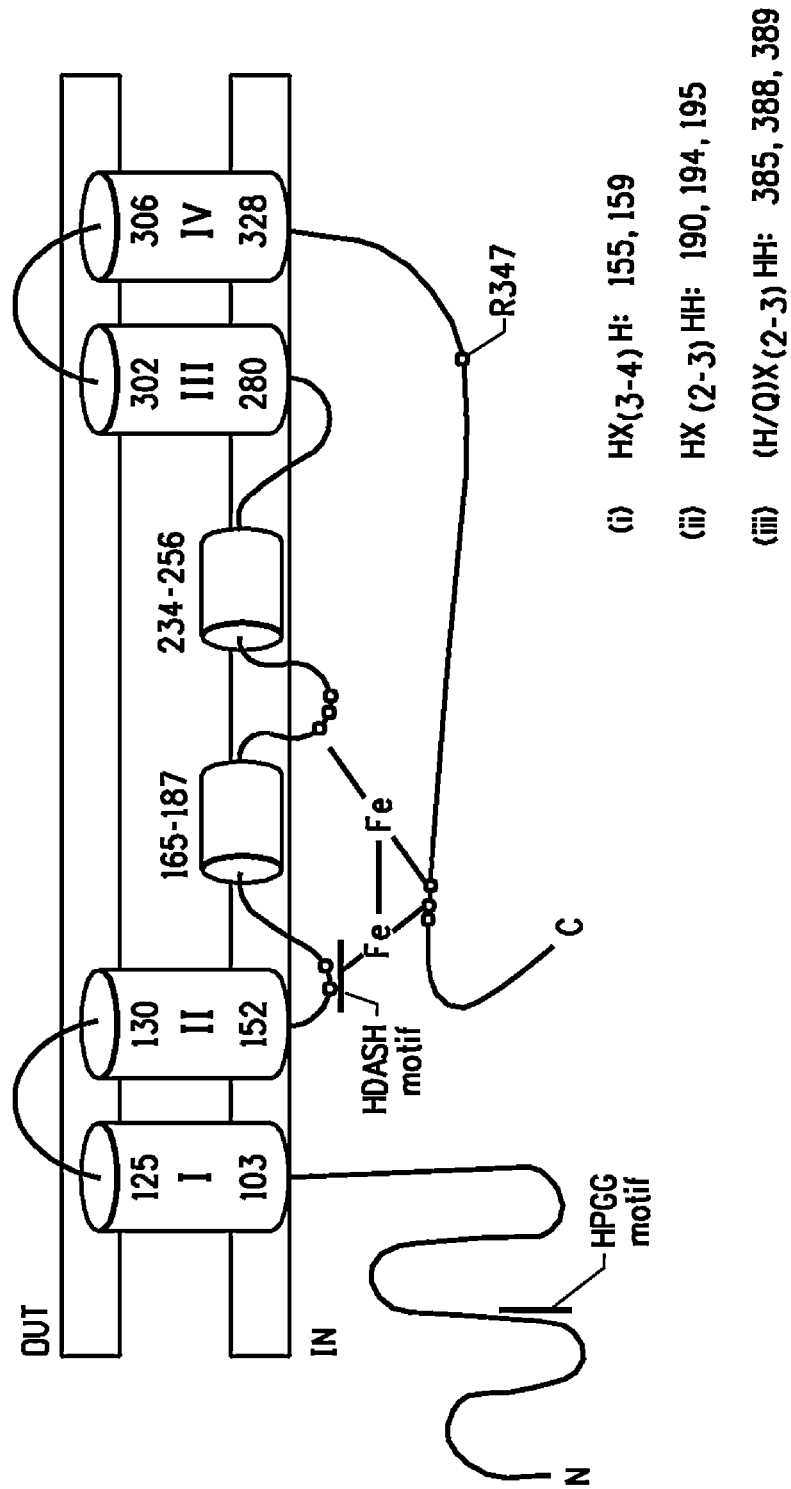
FIG. 2 is a predicted topological model of the *Euglena gracilis* delta-5 desaturase enzyme.

Thus, the final topology model predicted for EgD5 is shown in FIG. 2. The vertical cylinders indicate membrane spanning domains, while the horizontal cylinders indicate the two highly hydrophobic regions that are not membrane spanning, but lie near the inner membrane surface. The circles correspond to the His residues presumably involved in the active site. The locations of the HPGG (SEQ ID NO:7) motif and HDASH (SEQ ID NO:8) motif are also identified. Finally, "IN" corresponds with the cytoplasmid space while "OUT" corresponds with the periplasmic space.

Example 2

Determination of Natural HDASH (SEQ ID NO:8) Motif Variation in Desaturases

Selected desaturase protein sequences were examined to determine whether natural variation occurred within the HDASH (SEQ ID NO:8) motif. Specifically, the desaturase proteins included the *Euglena gracilis* delta-5 desaturase ["EgD5"; U.S. Pat. No. 7,678,560], the Morteriella alpina delta-5 desaturase ["MaD5"; U.S. Pat. No. 5,972,664], and BLAST hits to other known delta-5 desaturases and/or delta-6 desaturases that are known to be closely related to delta-5 desaturases. The selected sequences were aligned using the MegAlign™ program of the LASERGENE bioinformatics computing suite (DNASTAR Inc., Madison, Wis.), and the HDASH motif (or variant thereof) is summarized below in Table 4.

TABLE 4

Natural Variants Of The HDASH (SEQ ID NO: 8) Motif

| Gen Bank Accession No. or Patent Number | Organism | Variant HDASH Motif | SEQ ID NO |
|---|---|---|---|
| CBL59059.1 (gi_295016816) | *Mortierella alpina* | HDASH | 8 |
| CAL49887.1 (gi_116001271) | *Phytophthora sojae* | HDASH | 8 |
| CBL59057.1 (gi_295016812) | *Physcomitrella patens* | HDgnH | 235 |
| CAT16395.1 (gi_218101624) | *Euglena gracilis* | HDASH | 8 |
| CBL59055.1 (gi_295016808) | *Phaeodactylum tricornutum* | HDAnH | 236 |
| CBL59102.1 (gi_295016902) | *Thalassiosira pseudonana* | HDAnH | 236 |
| CAM55833.1 (gi_126633754) | *Thalassiosira pseudonana* | HDAnH | 236 |
| AAL13311.1 (gi_16033740) | *Pythium irregulare* | HDsSH | 16 |
| CAD53323.1 (gi_23894018) | *Phytophthora megasperma* | HDASH | 8 |

TABLE 4-continued

Natural Variants Of The HDASH (SEQ ID NO: 8) Motif

| Gen Bank Accession No. or Patent Number | Organism | Variant HDASH Motif | SEQ ID NO |
|---|---|---|---|
| BAD95486.1 (gi_62484905) | Mortierella alpina | HDASH | 8 |
| NP_501751.1 (gi_17542396) | Caenorhabditis elegans | HefaH | 237 |
| CAE65324.1 (gi_39585564) | Caenorhabditis briggsae | HeftH | 238 |
| AAM09687.1 (gi_20069123) | Thraustochytrium sp. ATCC 21685 | HemgH | 239 |
| CAJ07076.1 (gi_68124314) | Leishmania major strain Friedlin | HeAgH | 240 |
| AAH26831.1 (gi_20070924) | Mus musculus | HDfgH | 241 |
| NP_571720.2 (gi_42476248) | Danio rerio | HDfgH | 241 |
| AAL82631.2 (gi_55846441) | Salmo salar | HDygH | 242 |
| AAL92562.1 (gi_19879687) | Phaeodactylum tricornutum | HDAnH | 236 |
| AAX14502.1 (gi_60172920) | Thalassiosira pseudonana | HDAnH | 236 |
| AAT09160.1 (gi_47028617) | Nitzschia closterium f. minutissima | HDAnH | 236 |
| AAT85663.1 (gi_50882495) | Marchantia polymorpha | HDgnH | 235 |
| XP_638329.1 (gi_66809213) | Dictyostelium discoideum AX4 | HDscH | 243 |
| XP_640331.1 (gi_66812304) | Dictyostelium discoideum AX4 | HDAcH | 244 |
| U.S. Pat. No. 7,678,560 | Euglena gracilis | HDASH | 8 |
| U.S. Pat. No. 5,972,664 | Morteriella alpina | HDASH | 8 |

Based on the above analysis, it appeared that the Asp ["D"] residue of the HDASH (SEQ ID NO:8) motif could possibly be substituted with a Glu residue ["E"], the Ala ["A"] residue could possibly be substituted with a Gly ["G"], Ser ["S"], Phe ["F"], Tyr ["Y"] or Met ["M"] residue and/or the Ser ["S"] residue of the HDASH (SEQ ID NO:8) motif could possibly be substituted with a Cys ["C"], Asn ["N"], Gly ["G"], Ala ["A"] or Thr ["T"] residue.

Example 3

Sequence of Wild-Type Euglena gracilis Delta-5 Desaturase ["EgD5"]

U.S. Pat. No. 7,678,560 describes the isolation and cloning of a delta-5 desaturase from E. gracilis (i.e., EgD5, SEQ ID NO:21). Recently, more detailed analyses of the cloned EgD5 therein have identified one more variant "wildtype" E. gracilis delta-5 desaturase sequence, designated as EgD5R and set forth herein as SEQ ID NO:25, that was previously not appreciated. Instead of a Ser amino acid residue at position 347 of EgD5 as described in U.S. Pat. No. 7,678,560, EgD5R (SEQ ID NO:25) comprises an Arg residue at position 347. It is hypothesized that this discrepancy arose as a result of PCR or cDNA generation methodologies.

Specifically, EgD5 (SEQ ID NO:20, corresponding to SEQ ID NO:1 of U.S. Pat. No. 7,678,560) was obtained using 5'- and 3'-RACE techniques with double-stranded cDNA of E. gracilis as the template (Examples 4-5 of U.S. Pat. No. 7,678,560). Then, the ORF encoding the E. gracilis delta-5 desaturase was amplified by PCR using E. gracilis cDNA as the template, purified, subjected to restriction digestion and then directionally ligated into an appropriate vector to yield pDMW367 (Example 6 of U.S. Pat. No. 7,678,560). The sequence of pDMW367 was provided as SEQ ID NO:23 in U.S. Pat. No. 7,678,560 (corresponding to SEQ ID NO:38 herein). Although it was reported in U.S. Pat. No. 7,678,560 that pDMW367 comprised a chimeric FBAIN:EgD5:Pex20 gene, it is now appreciated that the delta-5 desaturase sequence within this chimeric gene was actually the nucleotide sequence of EgD5R (SEQ ID NO:24).

An alignment of EgD5 (SEQ ID NO:20) and EgD5R (SEQ ID NO:24) (FIGS. 3A, 3B, 3C and 3D) shows four nucleotide differences, wherein the mutations with respect to SEQ ID NO:20 are G819A, T948C, C1041A and G1349A. The G1349A mutation is attributed to the specific primer sequence utilized to amplify EgD5 for cloning into pDMW367. Alignment of the translated products of EgD5 (SEQ ID NO:21) and EgD5R (i.e., SEQ ID NO:25) reveals a single amino acid difference, i.e., the S347R mutation.

U.S. Pat. No. 7,678,560, Example 9 also describes the creation of a synthetic delta-5 desaturase derived from EgD5 and codon-optimized for expression in Yarrowia lipolytica (i.e., EgD5S; SEQ ID NOs:22 and 23). Codon-optimization of EgD5 resulted in modification of 196 bp of the 1350 bp coding region (14.5%) and optimization of 189 codons of the total 449 codons (42%). The protein sequence encoded by the codon-optimized EgD5S gene (i.e., SEQ ID NO:23) was identical to that of the wildtype protein sequence (i.e., SEQ ID NO:21), wherein the amino acid at 347 position is Ser.

Example 4

Generation of Construct pDMW367-M4, Comprising Wild-Type EgD5R with Four Restriction Endonuclease Sites Eliminated ["EgD5R*"]

The present Example describes the construction of plasmid pDMW367-M4, comprising a chimeric FBAIN:EgD5R*: Pex20 gene. EgD5R* (SEQ ID NO:26) was a modified variant of wildtype EgD5R (SEQ ID NO:24) created to facilitate subsequent cloning procedures, wherein the modifications resulted in removal of four restriction enzymes sites (i.e., EcoRI, HindIII, BglII and NcoI) from the wildtype EgD5R coding region. The amino acid sequences of EgD5R (SEQ ID NO:25) and EgD5R* (SEQ ID NO:27) are identical.

Specifically, plasmid pDMW367-M4 (SEQ ID NO:39; FIG. 4C) was derived from pDMW367 (SEQ ID NO:38, Example 3; FIG. 4A). The native EcoRI HindIII, BglII and NcoI restriction enzymes sites were sequentially eliminated from the EgD5R coding region to generate pDMW367-M4. First, the EcoRI and BglII sites were eliminated by in vitro mutagenesis using pDMW367 (SEQ ID NO:38) as template, and two pairs of oligonucleotides as primers. Primer pair YL813 (SEQ ID NO:40) and YL814 (SEQ ID NO:41) enabled mutation of the EcoI site, while primer pair YL815 (SEQ ID NO:42) and YL816 (SEQ ID NO:43) enabled mutation of the BglII site. These reactions generated construct pDMW367-M2 (FIG. 4B; SEQ ID NO:44). Sequence analysis confirmed that the amino acid sequence of the variant EgD5R in pDMW367-M2 was identical to the amino acid sequence of EgD5R in pDMW367.

Then, the HindIII and NcoI sites were eliminated by in vitro mutagenesis using pDMW367-M2 as template, and two pairs of oligonucleotides as primers. Primer pair YL829 (SEQ ID NO:45) and YL830 (SEQ ID NO:46) enabled mutation of the HindIII site, while primer pair YL831 (SEQ ID NO:47) and YL832 (SEQ ID NO:48) enabled mutation of the NcoI site. This resulted in generation of pDMW367-M4. Again, sequence analysis confirmed that the amino acid sequence of the variant EgD5 (i.e., EgD5R*) in pDMW367-M4 was identical to the amino acid sequence of EgD5R in pDMW367.

For subsequent examples, reference to the wildtype EgD5 will effectively include reference to EgD5R (SEQ ID NOs:24 and 25) and EgD5R* (SEQ ID NOs:26 and 27), unless otherwise specified.

Example 5

Identification of HDxSH (SEQ ID NO:36) Mutations that Result in Similar Delta-5 Desaturase Activity to the Delta-5 Desaturase Activity of EgD5R*

The HDASH (SEQ ID NO:8) motif spans from amino acid residues 155 to 159 of EgD5R* (SEQ ID NO:27). Single amino acid mutations were carried out using pDMW367-M4 (Example 4) as the template and 19 pairs of oligonucleotides (SEQ ID NOs:49-86; Table 5, infra) as primers to individually mutate the Ala residue of the HDASH (SEQ ID NO:8) motif of EgD5R* by site-directed mutagenesis (QuickChange Kit, Stratagene, Calif.), thereby generating all amino acid substitutions possible (i.e., HDxSH [SEQ ID NO:36] mutants). Plasmids from each mutation were transformed into E. coli XL2Blue cells. Three colonies from each of the 19 transformations were picked and grown individually in liquid media at 37° C. overnight. Plasmids (i.e., 57 total) were isolated from these cultures and sequenced individually to confirm the mutations.

The wild type pDMW367-M4 plasmid and the isolated mutant plasmids were transformed into Y. lipolytica strain Y4036U1 individually, as described in the General Methods. The transformants were selected on MMLeu plates. After 2 days growth at 30° C., three transformants from each transformation reaction were streaked out onto new MMLeu plates and incubated for an additional 2 days at 30° C. The colonies were then used to inoculate 3 mL of MMLeu in a 24 well Qiagen block. The blocks were incubated in a 30° C. incubator shaking at 200 rpm. After the cultures were incubated for 2 days, the blocks were centrifuged, the supernatant was removed and 3 mL of HGM was added. The blocks were placed back in a 30° C. incubator shaking at 200 rpm for an additional 5 days. The cells were collected by centrifugation, lipids were extracted, and fatty acid methyl esters ["FAMEs"] were prepared by trans-esterification, and subsequently analyzed with a Hewlett-Packard 6890 GC.

The delta-5 desaturase activity (average of 3 transformants) attributed to each mutant HDxSH (SEQ ID NO:36) motif is summarized below in Table 5. Transformants comprising mutant pDMW367-M4 constructs, wherein the mutant constructs comprise EgD5R* mutants, are designated according to the amino acid substitution that occurred for the Ala residue at position 157 within EgD5R* (i.e., transformant pDMW367M4-157c comprises a mutant delta-5 desaturase designated as EgD5R*-157c, and having a Cys for Ala substitution at position 157, thereby yielding a HDcSH [SEQ ID NO:277] motif; transformant pDMW367M4-157g comprises a mutant delta-5 desaturase designated as EgD5R*-157g, and having a Gly for Ala substitution, thereby yielding a HDsSH [SEQ ID NO:15] motif, etc.). The conversion efficiency ("Avg. Conv. Effic.") was measured according to the following formula: ([product]/[substrate+product])*100, where 'product' includes the immediate product and all products in the pathway derived from it. Results are compared to that of the wildtype EgD5R* (SEQ ID NO:26) within plasmid pDMW367-M4, wherein GC analysis determined 10.8% DGLA and 3.6% ARA of total lipids were produced by the transformants (i.e., average conversion efficiency was 24.8%).

TABLE 5

Delta-5 Desaturase Activity In EgD5R And HDxSH (SEQ ID NO: 36) Motif Mutants

| Y4036U1 Transformant * | SEQ ID NOs Of Primers | Sequence of Mutant HDASH Motif | Avg. Conv. Effic. | Percent Activity ** |
|---|---|---|---|---|
| pDMW367-M4 | — | HDASH (SEQ ID NO: 8) | 24.8% | 100 |
| pDMW367M4-157c | 49 and 50 | HDcSH (SEQ ID NO: 277) | 10.7% | 43.1% |
| pDMW367M4-157d | 51 and 52 | HDdSH (SEQ ID NO: 278) | 1.0% | 4.0% |
| pDMW367M4-157e | 53 and 54 | HDeSH (SEQ ID NO: 279) | 0.9% | 3.6% |
| pDMW367M4-157f | 55 and 56 | HDfSH (SEQ ID NO: 280) | 1.0% | 4.0% |
| pDMW367M4-157g | 57 and 58 | HDgSH (SEQ ID NO: 15) | 23.8% | 96% |
| pDMW367M4-157h | 59 and 60 | HDhSH (SEQ ID NO: 281) | 1.0% | 4.0% |

TABLE 5-continued

Delta-5 Desaturase Activity In EgD5R And HDxSH (SEQ ID NO: 36) Motif Mutants

| Y4036U1 Transformant * | SEQ ID NOs Of Primers | Sequence of Mutant HDASH Motif | Avg. Conv. Effic. | Percent Activity ** |
|---|---|---|---|---|
| pDMW367M4-157i | 61 and 62 | HDiSH (SEQ ID NO: 282) | 0.9% | 3.6% |
| pDMW367M4-157k | 63 and 64 | HDkSH (SEQ ID NO: 283) | 1.0% | 4.0% |
| pDMW367M4-157l | 65 and 66 | HDlSH (SEQ ID NO: 284) | 1.1% | 4.4% |
| pDMW367M4-157m | 67 and 68 | HDmSH (SEQ ID NO: 285) | 1.0% | 4.0% |
| pDMW367M4-157n | 69 and 70 | HDnSH (SEQ ID NO: 286) | 1.1% | 4.4% |
| pDMW367M4-157p | 71 and 72 | HDpSH (SEQ ID NO: 287) | 2.3% | 9.3% |
| pDMW367M4-157q | 73 and 74 | HDqSH (SEQ ID NO: 288) | 0.6% | 2.4% |
| pDMW367M4-157r | 75 and 76 | HDrSH (SEQ ID NO: 289) | 0.8% | 3.2% |
| pDMW367M4-157s | 77 and 78 | HDsSH (SEQ ID NO: 16) | 23.3% | 94% |
| pDMW367M4-157t | 79 and 80 | HDtSH (SEQ ID NO: 290) | 1.0% | 4.0% |
| pDMW367M4-157v | 81 and 82 | HDvSH (SEQ ID NO: 291) | 0.3% | 1.2% |
| pDMW367M4-157w | 83 and 84 | HDwSH (SEQ ID NO: 292) | 0.9% | 3.6% |
| pDMW367M4-157y | 85 and 86 | HDySH (SEQ ID NO: 293) | 0.7% | 2.8% |

* Each EgD5R* gene (mutant or wildtype) was expressed within pDMW367-M4.
** Percent Activity is with respect to EgD5R*.

Based on the above, it is clear that the Ala residue within the HDASH (SEQ ID NO:8) motif can be substituted with either Gly or Ser without substantially affecting the delta-5 desaturase activity of EgD5R*. Specifically, EgD5R*-157g (SEQ ID NO:87) in pDMW367M4-157g transformants was able to convert DGLA to ARA with 23.8% conversion efficiency, while EgD5R*-157s (SEQ ID NO:88) in pDMW367M4-157s transformants was able to convert DGLA to ARA with 23.3% conversion efficiency.

Example 6

Identification of HDAxH (SEQ ID NO:37) Mutations that Result in Similar Delta-5 Desaturase Activity to the Delta-5 Desaturase Activity of EgD5R*

Single amino acid mutations were carried out using pDMW367-M4 (Example 4) as the template and 19 pairs of oligonucleotides (SEQ ID NOs:89-126; Table 6, infra) as primers to individually mutate the Ser residue of the HDASH (SEQ ID NO:8) motif of EgD5R* (SEQ ID NO:27) by site-directed mutagenesis (QuickChange Kit, Stratagene, Calif.), thereby generating all amino acid substitutions possible (i.e., HDAxH [SEQ ID NO:37] mutants). Following mutagenesis, plasmids were transformed into Y. lipolytica Y4036U1, transformants were selected and grown in MMLeu and HGM, and FAMEs were prepared and analyzed by GC, as described in Example 5.

The delta-5 desaturase activity (average of 3 transformants) attributed to each mutation within the HDASH (SEQ ID NO:8) motif is summarized below in Table 6. Transformants comprising mutant pDMW367-M4 constructs, wherein the mutant constructs comprise EgD5R* mutants, are designated according to the amino acid substitution that occurred for the Ser residue at position 158 within EgD5R* (i.e., transformant pDMW367M4-158a comprises a mutant delta-5 desaturase designated as EgD5R*-158a, and having an Ala for Ser substitution at position 158, thereby yielding a HDAaH [SEQ ID NO:17] motif; transformant pDMW367M4-158r comprises a mutant delta-5 desaturase designated as EgD5R*-158r, and having an Arg for Ser substitution, thereby yielding a HDArH [SEQ ID NO:306] motif, etc.). Conversion efficiency was measured according to the formula described in Example 5. Results are compared to that of the wildtype EgD5R* (SEQ ID NO:26) within plasmid pDMW367-M4, wherein GC analysis determined 11.3% DGLA and 3.4% ARA of total lipids were produced by the transformants (i.e., average conversion efficiency was 23.3%).

TABLE 6

Delta-5 Desaturase Activity In EgD5R* And HDAxH (SEQ ID NO: 37) Motif Mutants

| Y4036U1 Transformant * | SEQ ID NOs Of Primers | Sequence of Mutant HDASH Motif | Avg. Conv. Effic. | Percent Activity ** |
|---|---|---|---|---|
| pDMW367-M4 | — | HDASH (SEQ ID NO: 8) | 23.3% | 100% |
| pDMW367M4-158a | 89 and 90 | HDAaH (SEQ ID NO: 17) | 23.5% | 100.9% |
| pDMW367M4-158c | 91 and 92 | HDAcH (SEQ ID NO: 294) | 17.9% | 76.8% |
| pDMW367M4-158d | 93 and 94 | HDAdH (SEQ ID NO: 295) | 2.8% | 12.0% |
| pDMW367M4-158e | 95 and 96 | HDAeH (SEQ ID NO: 296) | 1.9% | 8.2% |

TABLE 6-continued

Delta-5 Desaturase Activity In EgD5R* And HDAxH
(SEQ ID NO: 37) Motif Mutants

| Y4036U1 Transformant * | SEQ ID NOs Of Primers | Sequence of Mutant HDASH Motif | Avg. Conv. Effic. | Percent Activity ** |
|---|---|---|---|---|
| pDMW367M4-158f | 97 and 98 | HDAfH (SEQ ID NO: 297) | 1% | 4.3% |
| pDMW367M4-158g | 99 and 100 | HDAgH (SEQ ID NO: 18) | 25.1% | 107.7% |
| pDMW367M4-158h | 101 and 102 | HDAhH (SEQ ID NO: 298) | 1.6% | 6.9% |
| pDMW367M4-158i | 103 and 104 | HDAiH (SEQ ID NO: 299) | 1.1% | 4.7% |
| pDMW367M4-158k | 105 and 106 | HDAkH (SEQ ID NO: 300) | 1% | 4.3% |
| pDMW367M4-158l | 107 and 108 | HDAlH (SEQ ID NO: 301) | 1.1% | 4.7% |
| pDMW367M4-158m | 109 and 110 | HDAmH (SEQ ID NO: 302) | 2.3% | 9.9% |
| pDMW367M4-158n | 111 and 112 | HDAnH (SEQ ID NO: 303) | 16.5% | 70.8% |
| pDMW367M4-158p | 113 and 114 | HDApH (SEQ ID NO: 304) | 1.2% | 5.2% |
| pDMW367M4-158q | 115 and 116 | HDAqH (SEQ ID NO: 305) | 10.4% | 44.6% |
| pDMW367M4-158r | 117 and 118 | HDArH (SEQ ID NO: 306) | 10.0% | 42.9% |
| pDMW367M4-158t | 119 and 120 | HDAtH (SEQ ID NO: 307) | 9.6% | 41.2% |
| pDMW367M4-158v | 121 and 122 | HDAvH (SEQ ID NO: 308) | 1.5% | 6.4% |
| pDMW367M4-158w | 123 and 124 | HDAwH (SEQ ID NO: 309) | 9.3% | 40.0% |
| pDMW367M4-158y | 125 and 126 | HDAyH (SEQ ID NO: 310) | 1.1% | 4.7% |

* Each EgD5R* gene (mutant or wildtype) was expressed within pDMW367-M4.
** Percent Activity is with respect to EgD5R*.

The results demonstrated that the Ser residue within the HDASH (SEQ ID NO:8) motif can be substituted with either Ala or Gly without substantially affecting the delta-5 desaturase activity of EgD5R*. Specifically, EgD5R*-158a (SEQ ID NO:127) in pDMW367M4-158a transformants was able to convert DGLA to ARA with 23.5% conversion efficiency, while EgD5R*-158g (SEQ ID NO:128) in pDMW367M4-158g transformants was able to convert DGLA to ARA with 25.1% conversion efficiency.

Example 7

Identification of HxGx (SEQ ID NO:34) and HDxxH (SEQ ID NO:311) Mutations that Result in Similar Delta-5 Desaturase Activity to the Delta-5 Desaturase Activity of EgD5R*

U.S. Pat. Pub. No. 2010-0075386-A1 describes mutant delta-5 desaturases which possess at least one mutation within the HPGG (SEQ ID NO:7) motif of the cytochome $b_5$-like domain (i.e., HxGx [SEQ ID NO:34] mutations). The HPGG (SEQ ID NO:7) motif spans from amino acid residues 33 to 36 of EgD5R (SEQ ID NO:25).

The present Example introduces mutations within the HPGG (SEQ ID NO:7) motif of EgD5R*-157g (Example 5, SEQ ID NO:87), EgD5R*-158a (Example 6, SEQ ID NO:127) and EgD5R*-158g (Example 6, SEQ ID NO:128) to see the effect of double mutations within the HPGG (SEQ ID NO:7) and HDASH (SEQ ID NO:8) domains.

Single amino acid mutations were carried out using pDMW367M4-157g (Example 5, SEQ ID NO:129), pDMW367M4-158a (Example 6, SEQ ID NO:130) and pDMW367-158g (Example 6, SEQ ID NO:131) as the template and several pairs of oligonucleotides (SEQ ID NOs:132-137; Table 7) as primers to individually mutate either the Pro residue or the second Gly residue of the HPGG (SEQ ID NO:7) motif of the mutant delta-5 desaturase gene by site-directed mutagenesis (QuickChange Kit, Stratagene, Calif.), thereby generating double mutations within the HPGG (SEQ ID NO:7) and HDASH (SEQ ID NO:8) motifs. Following mutagenesis, plasmids were transformed into *Y. lipolytica* strain Y4036U1, transformants were selected and grown in MMLeu and HGM, and FAMEs were prepared and analyzed by GC, as described in Example 5.

The delta-5 desaturase activity of mutant delta-5 desaturases with both HxGx (SEQ ID NO:34) and HDxxH (SEQ ID NO:311) mutations are summarized below in Table 7. Transformants comprising mutant pDMW367M4 constructs, wherein the mutant constructs comprise EgD5R* mutants, are designated according to the amino acid substitution for the Pro residue or the second Gly residue within the HPGG (SEQ ID NO:7) motif of EgD5R*, combined with the amino acid substitution for the Ala residue or Ser residue within the HDASH (SEQ ID NO:8) motif of EgD5R*. That is, e.g., transformant pDMW367-34g158g comprises a mutant delta-5 desaturase designated as EgD5R*-34g158g, having a Gly for Pro substitution at position 34 (thereby yielding a HgGG [SEQ ID NO:9] motif) and having a Gly for Ser substitution at position 158 (thereby yielding a HDAgG [SEQ ID NO:18] motif), etc. Conversion efficiency was measured according to the formula described in Example 5. Results are compared to that of the wild-type EgD5R* within plasmid pDMW367-M4, wherein GC analysis determined 11.7% DGLA and 4.4% ARA of total lipids were produced by the transformants (i.e., average conversion efficiency was 27.5%).

HDASH (SEQ ID NO:8) motif for Ala or Gly. The Pro residue within the HPGG (SEQ ID NO:7) motif can also be substituted with His with simultaneous substitution of the Ser residue within the HDASH (SEQ ID NO:8) motif for either Ala or Gly. And, the second Gly residue within the HPGG (SEQ ID NO:7) motif can be substituted with Ser with simultaneous substitution of Ser within the HDASH (SEQ ID NO:8) motif for either Ala or Gly.

Preferred double mutants were EgD5R*-34g157g (SEQ ID NO:139; capable of converting DGLA to ARA with 22.9% conversion efficiency in pDMW367-34g157g transformants), EgD5R*-34g158a (SEQ ID NO:141; capable of converting DGLA to ARA with 24.3% conversion efficiency in pDMW367-34g158a transformants) and EgD5R*-34g158g (SEQ ID NO:143; capable of converting DGLA to ARA with 26.8% conversion efficiency in pDMW367-34g158g transformants).

Example 8

Synthesis of an N-Terminal Codon-Optimized Mutant Delta-5 Desaturase Gene ("EgD5M") for Expression in *Yarrowia lipolytica*, Derived from EgD5R*-34g158g The codon usage of the 5' portion of EgD5R*-34g158g (SEQ ID NO:142, Example 7) was optimized for expression

TABLE 7

Delta-5 Desaturase Activity In EgD5R* Mutants Simultaneously Comprising HxGx (SEQ ID NO: 34) And HDxxH (SEQ ID NO: 311) Motifs

| Y4036U1 Transformant | Mutant Gene | SEQ ID NOs Of Primers | Sequence Of Mutant HPGG Motif | Sequence Of Mutant HDASH Motif | Average Conversion Efficiency | Percent Activity With Respect to EgD5R* |
|---|---|---|---|---|---|---|
| pDMW367-M4 | — | — | HPGG (SEQ ID NO: 7) | HDASH (SEQ ID NO: 8) | 27.5% | 100% |
| pDMW367-34g157g | EgD5R*-34g157g (SEQ ID NOs: 138 and 139) | 132 and 133 | HgGG (SEQ ID NO: 9) | HDgSH (SEQ ID NO: 15) | 22.9% | 83% |
| pDMW367-34g158a | EgD5R*-34g158a (SEQ ID NOs: 140 and 141) | 132 and 133 | HgGG (SEQ ID NO: 9) | HDAaH (SEQ ID NO: 17) | 24.3% | 88% |
| pDMW367-34g158g | EgD5R*-34g158g (SEQ ID NOs: 142 and 143) | 132 and 133 | HgGG (SEQ ID NO: 9) | HDAgH (SEQ ID NO: 18) | 26.8% | 97% |
| pDMW367-34h158a | EgD5R*-34h158a (SEQ ID NOs: 144 and 145) | 134 and 135 | HhGG (SEQ ID NO: 10) | HDAaH (SEQ ID NO: 17) | 18.7% | 68% |
| pDMW367-34h158g | EgD5R*-34h158g (SEQ ID NOs: 146 and 147) | 134 and 135 | HhGG (SEQ ID NO: 10) | HDAgH (SEQ ID NO: 18) | 22% | 80% |
| pDMW367-36s158a | EgD5R*-34s158a (SEQ ID NOs: 148 and 149) | 136 and 137 | HPGs (SEQ ID NO: 11) | HDAaH (SEQ ID NO: 17) | 17.5% | 64% |
| pDMW367-36s158g | EgD5R*-34s158g (SEQ ID NOs: 150 and 151) | 136 and 137 | HPGs (SEQ ID NO: 11) | HDAgH (SEQ ID NO: 18) | 18.9% | 69% |

*Each EgD5R* gene (mutant or wildtype) was expressed within pDMW367-M4.

The results demonstrated that although the HPGG (SEQ ID NO:7) motif and the HDASH (SEQ ID NO:8) motif are important to delta-5 desaturase enzymatic activity, desaturases may be constructed having HxGx (SEQ ID NO:34) and HDxxH (SEQ ID NO:311) motifs that retain at least 64% of delta-5 desaturase activity when compared to the wildtype. Specifically, the Pro residue within the HPGG (SEQ ID NO:7) motif can be substituted with Gly with simultaneous substitution of either: 1) the Ala residue within the HDASH (SEQ ID NO:8) motif for Gly; or, 2) the Ser residue within the in *Y. lipolytica*, in a manner similar to that described in U.S. Pat. No. 7,125,672. Specifically, the first 204 bp of EgD5R*-34g158g were codon-optimized, to result in synthesis of a codon-optimized delta-5 desaturase gene designated "EgD5M" (SEQ ID NOs:152 and 153). EgD5M was designed based on the coding sequence of the delta-5 desaturase gene of EgD5R*-34g158g, according to the *Yarrowia* codon usage pattern (U.S. Pat. No. 7,125,672), the consensus sequence around the 'ATG' translation initiation codon, and the general rules of RNA stability (Guhaniyogi, G. and J.

Figure 5:
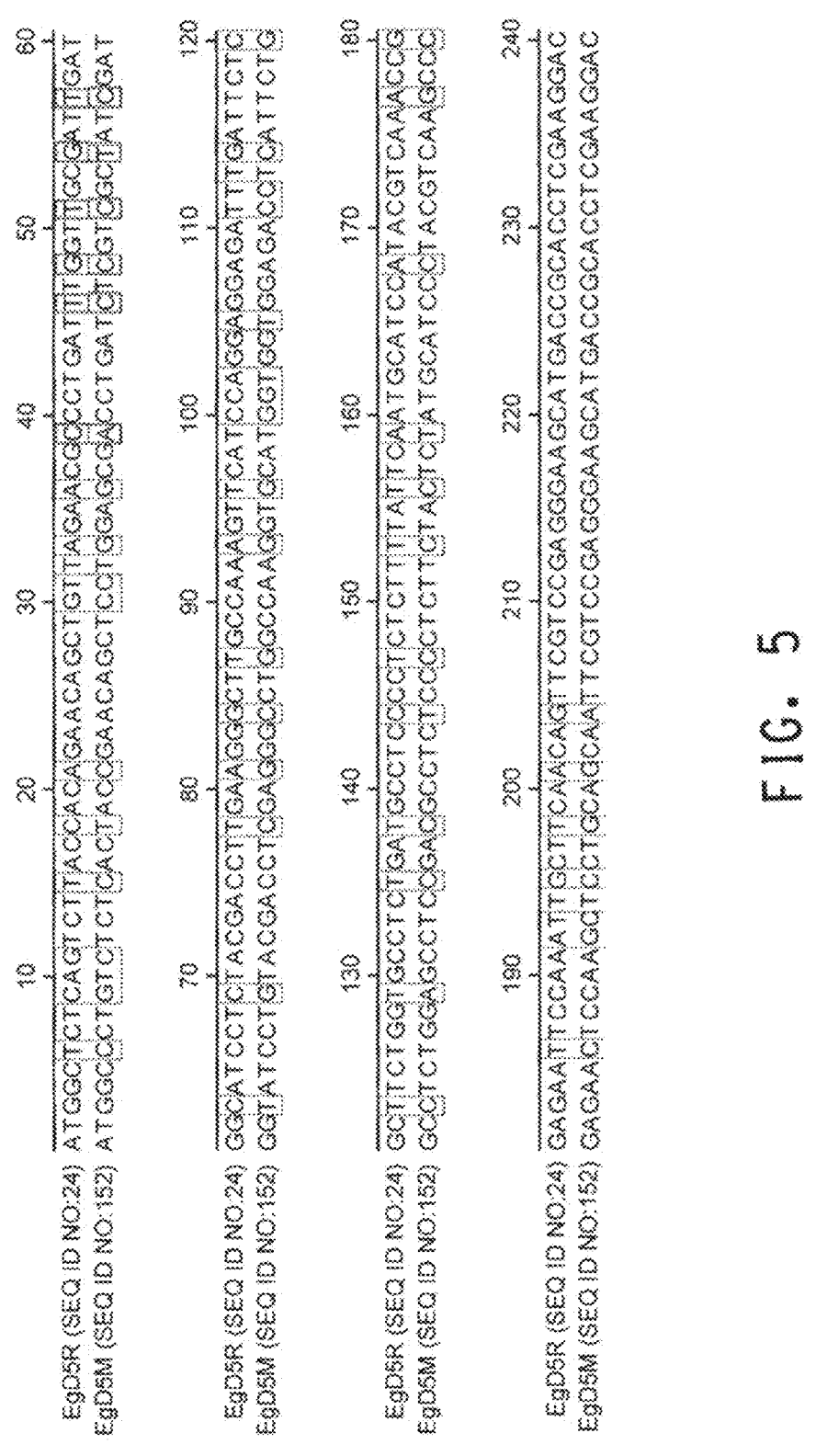

Brewer, *Gene*, 265(1-2):11-23 (2001)). In addition to modification of the translation initiation site, 52 bp of the 204 bp within the N-terminus of the coding region were modified (25.5%; FIG. 5), and 45 codons of the 68 amino acids within the N-terminus of the desaturase protein were optimized (66.2%). A NcoI site and NotI sites were incorporated around the translation initiation codon and after the stop codon of EgD5M, respectively. The protein sequence encoded by the codon-optimized EgD5M gene (i.e., SEQ ID NO:153) is identical to that of the wildtype EgD5R*-34g158g protein sequence (i.e., SEQ ID NO:143). The designed EgD5M gene (SEQ ID NO:152) was synthesized by GenScript Corporation (Piscataway, N.J.) and cloned into pUC57 (GenBank Accession No. Y14837) to generate pEgD5M (FIG. 6A; SEQ ID NO:154).

Example 9

Generation of Construct pDMW367-5M, Comprising EgD5M

The present Example describes the construction of plasmid pDMW367-5M comprising a chimeric FBAIN:EgD5M:Pex20 gene. Plasmid pDMW367-5M (FIG. 6B; SEQ ID NO:155) was constructed by replacing the NcoI/NotI EgD5R* fragment of pDMW367-M4 (FIG. 4; SEQ ID NO:39) with the NcoI/NotI EgD5M fragment from pEgD5M (FIG. 6A; SEQ ID NO:154). The product of this ligation was pDMW367-5M, which thereby contained the following components:

TABLE 8

Components Of Plasmid pDMW367-5M (SEQ ID NO: 155)

| RE Sites And Nucleotides Within SEQ ID NO: 155 | Description Of Fragment And Chimeric Gene Components |
|---|---|
| EcoR I/BsiW I (6063-318) | FBAIN::EgD5M::Pex20, comprising: FBAIN: *Yarrowia lipolytica* FBAIN promoter (U.S. Pat. No. 7,202,356); EgD5M: synthetic mutant N-terminal codon-optimized EgD5R*-34g158g ["EgD5M"] delta-5 desaturase (SEQ ID NO: 152), derived from *Euglena gracilis*; Pex20: Pex20 terminator sequence of *Yarrowia* Pex20 gene (GenBank Accession No. AF054613) |
| 1354-474 | ColE1 plasmid origin of replication |
| 2284-1424 | ampicillin-resistance gene (AmpR) for selection in *E. coli* |
| 3183-4476 | *Yarrowia* autonomous replication sequence (ARS18; GenBank Accession No. A17608) |
| 6020-4533 | *Yarrowia* Ura 3 gene (GenBank Accession No. AJ306421) |

Example 10

Generation of Construct pDMW367-5M1, Comprising Variant "EgD5M1" of the N-Terminal Codon-Optimized Mutant Delta-5 Desaturase Gene The present Example describes the construction of plasmid pDMW367-5M1 comprising a chimeric FBAIN:EgD5M1:Pex20 gene. The nucleotide sequence of EgD5M1 (SEQ ID NO:156) is identical to that of EgD5M (SEQ ID NO:152), except the CGA codon for Arg at position 347 in EgD5M was changed to encode an AGC codon for Ser in EgD5M1. This modification was designed to analyze the effect of the R347S mutation (described in Example 3) on delta-5 desaturase activity.

The designed EgD5M1 gene (also referred to as "EgD5R*-34g158g347S"; SEQ ID NO:156) was synthesized by GenScript Corporation (Piscataway, N.J.) and cloned into pUC57 (GenBank Accession No. Y14837) to generate pEgD5M1 (SEQ ID NO:158).

Plasmid pDMW367-5M1 (SEQ ID NO:159) was constructed by replacing the NcoI/NotI EgD5R* fragment of pDMW367-M4 (FIG. 4; SEQ ID NO:39) with the NcoI/NotI EgD5M1 fragment from pEgD5M1 (SEQ ID NO:158). The product of this ligation was pDMW367-5M1, comprising a chimeric FBAIN:EgD5M1:Pex20 gene.

Example 11

Functional Analyses of EgD5M And EgD5M1 Delta-5 Desaturases In *Yarrowia lipolytica* Strain Y4036U1

Control plasmid pDMW367-M4 (SEQ ID NO:39; Example 4) and plasmids pDMW367-5M (SEQ ID NO:155; Example 9) and pDMW367-5M1 (SEQ ID NO:159; Example 10) were each separately transformed into *Y. lipolytica* strain Y4036U1. Transformants were selected and grown in MMLeu and HGM, and FAMEs were prepared and analyzed by GC, as described in Example 5.

The delta-5 desaturase activity (average of 3 transformants) of EgD5R*, EgD5M and EgD5M1 are summarized below in Table 9. Conversion efficiency ("Cony. Effic.") was measured according to the formula described in Example 5. Results are compared to that of the wild-type EgD5R* (SEQ ID NO:26) within plasmid pDMW367-M4, wherein GC analysis determined 10.8% DGLA and 3.6% ARA of total lipids were produced by the transformants (i.e., average conversion efficiency was 24.8%).

TABLE 9

Delta-5 Desaturase Activity In EgD5R*, EgD5M And EgD5M1

| Plasmid Transformed into Y4036U1 | Delta-5 Desaturase | Sequence Of Mutant HPGG and HDASH Motifs | Amino Acid At Residue 347 | Average Conv. Effic. |
|---|---|---|---|---|
| pDMW367-M4 | EgD5R* (SEQ ID NOs: 26 and 27) | HPGG (SEQ ID NO: 7), HDASH (SEQ ID NO: 8) | R | 24.8% |

TABLE 9-continued

Delta-5 Desaturase Activity In EgD5R*, EqD5M And EqD5M1

| Plasmid Transformed into Y4036U1 | Delta-5 Desaturase | Sequence Of Mutant HPGG and HDASH Motifs | Amino Acid At Residue 347 | Average Conv. Effic. |
|---|---|---|---|---|
| pDMW367-5M | EgD5M (SEQ ID NOs: 152 and 153) | HgGG (SEQ ID NO: 9), HDAgH (SEQ ID NO: 18) | R | 26.5% |
| pDMW367-5M1 | EgD5M1 (SEQ ID NOs: 156 and 157) | HgGG (SEQ ID NO: 9), HDAgH (SEQ ID NO: 18) | S | 27.6% |

The results demonstrated that both EgD5M (SEQ ID NO:153) and EgD5M1 (SEQ ID NO:157) had higher delta-5 desaturase activity than the wild-type EgD5R* (SEQ ID NO:27). The improved delta-5 desaturase activity of EgD5M1, when compared to EgD5M, demonstrates that amino acid residue 347 does affect the protein's delta-5 desaturase activity, with Ser preferred as opposed to Arg.

Example 12

Identification of HPGs (SEQ ID NO:11) And HxxxH (SEQ ID NO:1) Mutations in a Synthetic Delta-5 Desaturase Gene ("EgD5S") Derived from *Euglena gracilis* and Codon-Optimized for Expression In *Yarrowia lipolytica*

The present Example introduces mutations within the HDASH (SEQ ID NO:8) motif of a mutant EgD5S-36s (or "EgD5S-HPGs") gene to determine the effect of double mutations within the HPGG (SEQ ID NO:7) and HDASH (SEQ ID NO:8) conserved domains.

EgD5S (SEQ ID NOs:22 and 23) is a synthetic delta-5 desaturase derived from EgD5 (Example 3) and codon-optimized for expression in *Y. lipolytica* (U.S. Pat. No. 7,678,560). Although the amino acid sequence of EgD5S was identical to EgD5, the nucleotide sequences differ; specifically, in addition to modification of the translation initiation site, 196 bp of the 1350 bp coding region were modified (14.5%) and 189 codons were optimized (42%). The GC content was reduced from 55.5% within the wild type gene (i.e., EgD5) to 54.4% within the synthetic gene (i.e., EgD5S). And, a NcoI site and NotI sites were incorporated around the translation initiation codon and after the stop codon of EgD5S, respectively.

Examples 1 through 4 of U.S. Pat. Pub. No. 2010-0075386-A1 describe the identification of mutant EgD5S-36s (SEQ ID NO:160), using EgD5S as a template in site-directed mutagenesis reactions targeted to modify the second Gly residue of the HPGG (SEQ ID NO:7) motif of EgD5S, which spans from amino acid residues 33 to 36 of the cytochome $b_5$-like domain (i.e., HPGx [SEQ ID NO:33] mutations). Thus, mutant EgD5S-36s comprised an HPGs (SEQ ID NO:11) motif, wherein the second Gly residue of the HPGG (SEQ ID NO:7) motif was substituted with Ser using EgD5S (SEQ ID NO:23) as a template. The delta-5 desaturase activity of EgD5S-36s (U.S. Pat. Pub. No. 2010-0075386-A1) was about 106.9% of the delta-5 desaturase activity of EgD5S. Plasmid pDMW369S (SEQ ID NO:161) contains the mutant EgD5S-36s gene; the vector components are similar to those of pDME367-5M (FIG. 6B herein), with the exception of the mutant EgD5S-36s gene in place of the EgD5M gene).

Based on the successful generation of double EgD5R* mutants in Example 7 (i.e., simultaneously comprising mutant HPGG [SEQ ID NO:7] and mutant HDASH [SEQ ID NO:8] motifs), it was anticipated that similar HxxxH (SEQ ID NO:1) mutations would be tolerated when introduced into EgD5S-36s. Specifically, single amino acid mutations were carried out using pDMW369S (comprising a chimeric FBAIN:EgD5S-36S:Pex20 gene) as the template and 9 pairs of oligonucleotides (SEQ ID NOs:162-179; Table 10) as primers to individually mutate either the Asp, Ala or Ser residue within the HDASH (SEQ ID NO:8) motif of EgD5S-36s (SEQ ID NO:160) by site-directed mutagenesis (Quick-Change Kit, Stratagene, Calif.), thereby generating 9 selected amino acid substitutions. Following mutagenesis, plasmids were transformed into *Y. lipolytica* strain Y4036U1, transformants were selected and grown in MMLeu and HGM, and FAMEs were prepared and analyzed by GC, as described in Example 5.

The delta-5 desaturase activity (average of 3 transformants) of mutant delta-5 desaturases with both HPGs (SEQ ID NO:11) and HxxxH (SEQ ID NO:1) mutations are summarized below in Table 10. Transformants comprising mutant pDMW369S constructs, wherein the mutant constructs comprise mutants of EgD5S-36s, are designated according to the amino acid substitution that occurred for the Asp, Ala or Ser residue within the HDASH (SEQ ID NO:8) motif (i.e., transformant pDMW369s-156e comprises a mutant delta-5 desaturase designated as EgD5S-36s156e, and having a Glu for Asp substitution at position 156, thereby yielding a HeASH [SEQ ID NO:19] motif; transformant pDMW369s-157g comprises a mutant delta-5 desaturase designated as EgD5S-36s157g, and having a Gly for Ala substitution, thereby yielding a HDsSH [SEQ ID NO:15] motif, etc.). Conversion efficiency was measured according to the formula described in Example 5. Results are compared to that of EgD5S-36s (SEQ ID NO:160) within plasmid pDMW369S, wherein GC analysis determined 8.1% DGLA and 6.8% ARA of total lipids were produced by the transformants (i.e., average conversion efficiency was 45.8%).

TABLE 10

Delta-5 Desaturase Activity In EgD5S Mutants Simultaneously Comprising HPGs
(SEQ ID NO: 11) And Mutant HxxxH (SEQ ID NO: 1) Motifs

| Y4036U1 Transformant | Mutant Gene | SEQ ID NOs Of Primers | Sequence Of Mutant HDASH Motif | Average Conversion Efficiency | Percent Activity With Respect to EgD5S-36S |
|---|---|---|---|---|---|
| pDMW369S | EgD5S-36s (SEQ ID NO: 160) | — | HDASH (SEQ ID NO: 8) | 45.8% | 100% |
| pDMW369S-157f | EgD5S-36s157f | 162 and 163 | HDfSH (SEQ ID NO: 280) | 3.4% | 7.4% |
| pDMW369S-157m | EgD5S-36s157m | 164 and 165 | HDmSH (SEQ ID NO: 285) | 2.4% | 5.2% |
| pDMW369S-157g | EgD5S-36s157g (SEQ ID NOs: 182 and 183) | 166 and 167 | HDgSH (SEQ ID NO: 15) | 36.6% | 79.9% |
| pDMW369S-157S | EgD5S-36s157s | 168 and 169 | HDsSH (SEQ ID NO: 16) | 17.9% | 39.1% |
| pDMW369S-158a | EgD5S-36s158a (SEQ ID NOs: 184 and 185) | 170 and 171 | HDAaH (SEQ ID NO: 17) | 39.1% | 85.4% |
| pDMW369S-158n | EgD5S-36s158n | 172 and 173 | HDAnH (SEQ ID NO: 303) | 13.0% | 28.4% |
| pDMW369S-158t | EgD5S-36s158t | 174 and 175 | HDAtH (SEQ ID NO: 307) | 4.5% | 9.8% |
| pDMW369S-158g | EgD5S-36s158g (SEQ ID NOs: 186 and 187) | 176 and 177 | HDAgH (SEQ ID NO: 18) | 34.3% | 74.9% |
| pDMW369S-156e | EgD5S-36s156e (SEQ ID NOs: 180 and 181) | 178 and 179 | HeASH (SEQ ID NO: 19) | 36.2% | 79.0% |

The results demonstrated that the codon-optimized EgD5S delta-5 desaturase could be modified to comprise both mutant HPGG (SEQ ID NO:7) and mutant HDASH (SEQ ID NO:8) motifs, while still retaining reasonable delta-5 desaturase activity when compared to mutant EgD5S-36s having only a mutant HPGG motif (i.e., HPGs [SEQ ID NO:11]). Preferred double mutants were EgD5S-36s156e (SEQ ID NOs:180 and 181; capable of converting DGLA to ARA with 36.2% conversion efficiency in pDMW369s-156e transformants), EgD5S-36s157g (SEQ ID NOs:182 and 183; capable of converting DGLA to ARA with 36.6% conversion efficiency in pDMW369s-157g transformants), EgD5S-36s158a (SEQ ID NOs:184 and 185; capable of converting DGLA to ARA with 39.1% conversion efficiency in pDMW369s-158a transformants), and EgD5S-36s158g (SEQ ID NOs:186 and 187; capable of converting DGLA to ARA with 34.3% conversion efficiency in pDMW369s-158g transformants).

Example 13

Identification of HaGG (SEQ ID NO:14) and HxxxH (SEQ ID NO:1) Mutations in a Synthetic Delta-5 Desaturase Gene ("EaD5S") Derived from *Euglena anabaena* and Codon-Optimized for Expression in *Yarrowia lipolytica*

The present Example introduces mutations within the HDASH (SEQ ID NO:8) motif of a mutant EaD5S-35a (or "EaD5S-HaGG") gene to determine the effect of double mutations within the HPGG (SEQ ID NO:7) and HDASH (SEQ ID NO:8) conserved domains.

U.S. Pat. No. 7,943,365 describes the isolation and cloning of a delta-5 desaturase from *E. anabaena* (i.e., EaD5; SEQ ID NO:28). This gene was then codon-optimized for expression in *Y. lipolytica*, resulting in the synthetic delta-5 desaturase EaD5S (SEQ ID NO:30). Although the amino acid sequence of EaD5S was identical to EaD5, the nucleotide sequences differ; specifically, in addition to modification of the translation initiation site, 183 bp of the 1362 bp coding region were modified (13.4%) and 174 codons were optimized (38.3%). The GC content was reduced from 57.6% within the wild type gene (i.e., EaD5) to 54.6% within the synthetic gene (i.e., EaD5S). And, a NcoI site and NotI sites were incorporated around the translation initiation codon and after the stop codon of EaD5S, respectively.

Example 6 of U.S. Pat. Pub. No. 2010-0075386-A1 describes the identification of mutant EaD5S-35a (SEQ ID NO:188), using EaD5S as a template in site-directed mutagenesis reactions targeted to modify the Pro residue of the HPGG (SEQ ID NO:7) motif of EaD5S, which spans from amino acid residues 34 to 37 of the cytochome $b_5$-like domain (i.e., HxGG [SEQ ID NO:32] mutations). Thus, mutant EaD5S-35a (SEQ ID NO:188) comprised a HaGG (SEQ ID NO:14) motif, wherein the Pro residue of the HPGG (SEQ ID NO:7) motif was substituted with Ala using EaD5S (SEQ ID NO:31) as a template. The delta-5 desaturase activity of EaD5S-35a (U.S. Pat. Pub. No. 2010-0075386-A1) was about 99.2% of the delta-5 desaturase activity of the EaD5S. Plasmid pZuFmEaD5S-A(S) (SEQ ID NO:189) contains the mutant EaD5S-35a gene; the vector components are identical to those of pDMW367-5M (FIG. 6B herein), with the exception of the mutant EaD5S-35a gene in place of the EgD5M gene).

Based on the successful generation of double EgD5R* mutants in Example 7 and double EgD5S mutants in Example 12 (i.e., simultaneously comprising mutant HPGG [SEQ ID NO:7] and mutant HDASH [SEQ ID NO:8] motifs), it was anticipated that similar HxxxH (SEQ ID NO:1) mutations would be tolerated when introduced into EaD5S-35a. The HDASH (SEQ ID NO:8) motif, spans from amino acid residues 156 to 160 of EaD5S and EaD5S-35a.

Single amino acid mutations were carried out using pZuFmEaD5S-A(S) (comprising a chimeric FBAIN:EaD5S-35a:Pex20 gene) as the template and 9 pairs of oligonucleotides (SEQ ID NOs:190-211; Table 11) as primers to individually mutate Asp, Ala or Ser within the HDASH (SEQ ID NO:8) motif of EaD5S-35a (SEQ ID NO:188) by site-directed mutagenesis (QuickChange Kit, Stratagene, Calif.), thereby generating 9 selected amino acid substitutions. Following mutagenesis, plasmids were transformed into *Y. lipolytica* strain Y4036U1, transformants were selected and grown in MMLeu and HGM, and FAMEs were prepared and analyzed by GC, as described in Example 5.

The delta-5 desaturase activity (average of 3 transformants) of mutant delta-5 desaturases comprising HaGG (SEQ ID NO:14) and HxxxH (SEQ ID NO:1) mutations are summarized below in Table 11. Transformants comprising mutant pZuFmEaD5S-A(S) constructs, wherein the mutant constructs comprise mutants of EaD5S-35a, are designated according to the amino acid substitution that occurred for the Asp, Ala or Ser residue within the HDASH (SEQ ID NO:8) motif. That is, e.g., transformant pZuFmEaD5S-A(S)-157e comprises a mutant delta-5 desaturase designated as EaD5S-35a157e, and having a Glu for Asp substitution at position 157, thereby yielding a HeASH (SEQ ID NO:19) motif; transformant pZuFmEaD5S-A(S)-158g comprises a mutant delta-5 desaturase designated as EaD5S-35a158g, and having a Gly for Ala substitution, thereby yielding a HDsSH (SEQ ID NO:15) motif, etc. Conversion efficiency was measured according to the formula described in Example 5. Results are compared to that of EaD5S-35a (SEQ ID NO:188) within plasmid pZuFmEaD5S-A(S), wherein GC analysis determined 8.6% DGLA and 5.1% ARA of total lipids were produced by the transformants (i.e., average conversion efficiency was 37.2%).

TABLE 11

Delta-5 Desaturase Activity In EaD5S Mutants Simultaneously Comprising HaGG (SEQ ID NO: 14) And Mutant HxxxH (SEQ ID NO: 1) Motifs

| Y4036U1 Transformant | Mutant Gene | SEQ ID NOs Of Primers | Sequence Of Mutant HDASH Motif | Average Conversion Efficiency | Percent Activity With Respect to EaD5S-35a |
|---|---|---|---|---|---|
| pZuFmEaD5S-A(S) | EaD5S-35a (SEQ ID NO: 188) | — | HDASH (SEQ ID NO: 8) | 37.2% | 100% |
| pZuFmEaD5S-A(S)-157e | EaD5S-35a157e | 190 and 191 | HeASH (SEQ ID NO: 19) | 14.0% | 37.6% |
| pZuFmEaD5S-A(S)-158f | EaD5S-35a157f | 192 and 193 | HDfSH (SEQ ID NO: 280) | 2.1% | 5.6% |
| pZuFmEaD5S-A(S)-158g | EaD5S-35a158g (SEQ ID NOs: 212 and 213) | 194 and 195 | HDgSH (SEQ ID NO: 15) | 28.4% | 76.3% |
| pZuFmEaD5S-A(S)-158m | EaD5S-35a 158m | 196 and 197 | HDmSH (SEQ ID NO: 285) | 1.8% | 4.8% |
| pZuFmEaD5S-A(S)-158s | EaD5S-35a158s (SEQ ID NOs: 214 and 215) | 198 and 199 | HDsSH (SEQ ID NO: 16) | 27.4% | 73.7% |
| pZuFmEaD5S-A(S)-158y | EaD5S-35a158y | 200 and 201 | HDySH (SEQ ID NO: 293) | 1.9% | 5.1% |
| pZuFmEaD5S-A(S)-159a | EgD5S-35a159a | 202 and 203 | HDAaH (SEQ ID NO: 17) | 2.0% | 5.4% |
| pZuFmEaD5S-A(S)-159c | EaD5S-35a159c | 204 and 205 | HDAcH (SEQ ID NO: 294) | 14.2% | 38.2% |
| pZuFmEaD5S-A(S)-159g | EaD5S-35a159g (SEQ ID NOs: 216 and 217) | 206 and 207 | HDAgH (SEQ ID NO: 18) | 26.5% | 71.2% |
| pZuFmEaD5S-A(S)-159n | EaD5S-35a159n | 208 and 209 | HDAnH (SEQ ID NO: 303) | 4.2% | 11.3% |
| pZuFmEaD5S-A(S)-159t | EaD5S-35a159t | 210 and 211 | HDAtH (SEQ ID NO: 307) | 9.8% | 26.3% |

The results demonstrated that the codon-optimized EaD5S delta-5 desaturase can be modified to comprise both mutant HPGG (SEQ ID NO:7) and mutant HDASH (SEQ ID NO:8) motifs, while still retaining reasonable delta-5 desaturase activity when compared to the mutant EaD5S-35a having only a mutant HPGG motif (i.e., HaGG [SEQ ID NO:14]). Preferred double mutants were EaD5S-35a158g (SEQ ID NOs:212 and 213; capable of converting DGLA to ARA with 28.4% conversion efficiency in pZuFmEaD5S-A(S)-158g transformants), EaD5S-35a158s (SEQ ID NOs:214 and 215; capable of converting DGLA to ARA with 27.4% conversion efficiency in pZuFmEaD5S-A(S)-158s transformants), and EaD5S-35a159g (SEQ ID NOs:216 and 217; capable of converting DGLA to ARA with 26.5% conversion efficiency in pZuFmEaD5S-A(S)-159g transformants).

Example 14

Generation of *Yarrowia lipolytica* Strain Z1978 to Produce about 58.7% EPA of Total Fatty Acids The present Example describes the construction of strain Z1978, derived from *Yarrowia lipolytica* ATCC #20362, capable of producing about 58.7% EPA relative to the total fatty acids ["EPA % TFAs"] with 38.3% total lipid content ["TFAs % DCW"] via expression of a delta-9 elongase/delta-8 desaturase pathway.

Genotype of *Yarrowia lipolytica* Strain Y9502

The generation of strain Y9502 is described in U.S. Pat. Appl. Pub. No. 2010-0317072-A1. Strain Y9502, derived from *Y. lipolytica* ATCC #20362, was capable of producing about 57.0% EPA relative to the total lipids via expression of a delta-9 elongase/delta-8 desaturase pathway (FIG. 7).

The final genotype of strain Y9502 with respect to wildtype *Y. lipolytica* ATCC #20362 was Ura+, Pex3−, unknown 1−, unknown 2−, unknown 3−, unknown 4−, unknown 5−, unknown6−, unknown 7−, unknown 8−, unknown9−, unknown 10−, YAT1:ME3S:Pex16, GPD:ME3S:Pex20, YAT1:ME3S:Lip1, FBAINm:EgD9eS:Lip2, EXP1:EgD9eS:Lip1, GPAT:EgD9e:Lip2, YAT1:EgD9eS:Lip2, FBAINm:EgD8M:Pex20, EXP1:EgD8M:Pex16, FBAIN:EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, GPDIN::EgD5SM::Aco, GPM::EgD5SM::Oct, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, YAT1::MCS::Lip1, FBA::MCS::Lip1, YAT1::MaLPAAT1S::Pex16. Abbreviations are as follows: FmD12 is a *Fusarium moniliforme* delta-12 desaturase gene [U.S. Pat. No. 7,504,259]; FmD12S is a codon-optimized delta-12 desaturase gene, derived from *F. moniliforme* [U.S. Pat. No. 7,504,259]; MESS is a codon-optimized $C_{16/18}$ elongase gene, derived from *Mortierella alpina* [U.S. Pat. No. 7,470,532]; EgD9e is a *Euglena gracilis* delta-9 elongase gene [U.S. Pat. No. 7,645,604]; EgD9eS is a codon-optimized delta-9 elongase gene, derived from *E. gracilis* [U.S. Pat. No. 7,645,604]; EgD8M is a synthetic mutant delta-8 desaturase gene [U.S. Pat. No. 7,709,239], derived from *E. gracilis* [U.S. Pat. No. 7,256,033]; EaD8S is a codon-optimized delta-8 desaturase gene, derived from *Euglena anabaena* [U.S. Pat. No. 7,790,156]; E389D9eS/EgD8M is a DGLA synthase created by linking a codon-optimized delta-9 elongase gene ("E389D9eS"), derived from *Eutreptiella* sp. CCMP389 (U.S. Pat. No. 7,645,604) to the delta-8 desaturase "EgD8M" (supra) [U.S. Pat. Appl. Pub. No. 2008-0254191-A1]; EgD9eS/EgD8M is a DGLA synthase created by linking the delta-9 elongase "EgD9eS" (supra) to the delta-8 desaturase "EgD8M" (supra) [U.S. Pat. Appl. Pub. No. 2008-0254191-A1]; EaD9eS/EgD8M is a DGLA synthase created by linking a codon-optimized delta-9 elongase gene ("EaD9eS"), derived from *E. anabaena* [U.S. Pat. No. 7,794,701] to the delta-8 desaturase "EgD8M" (supra) [U.S. Pat. Appl. Pub. No. 2008-0254191-A1]; EgD5M and EgD5SM are synthetic mutant delta-5 desaturase genes comprising a mutant HPGs (SEQ ID NO:11) motif [U.S. Pat. App. Pub. 2010-0075386-A1], derived from *E. gracilis* [U.S. Pat. No. 7,678,560]; EaD5SM is a synthetic mutant delta-5 desaturase gene comprising a mutant HaGG (SEQ ID NO:14) motif [U.S. Pat. App. Pub. 2010-0075386-A1], derived from *E. anabaena* [U.S. Pat. No. 7,943,365]; PaD17 is a *Pythium aphanidermatum* delta-17 desaturase gene [U.S. Pat. No. 7,556,949]; PaD17S is a codon-optimized delta-17 desaturase gene, derived from *P. aphanidermatum* [U.S. Pat. No. 7,556,949]; YICPT1 is a *Yarrowia lipolytica* diacylglycerol cholinephosphotransferase gene [U.S. Pat. No. 7,932,077]; MCS is a codon-optimized malonyl-CoA synthetase gene, derived from *Rhizobium leguminosarum* bv. *viciae* 3841 [U.S. Pat. App. Pub. 2010-0159558-A1], and, MaLPAAT1S is a codon-optimized lysophosphatidic acid acyltransferase gene, derived from *Mortierella alpina* [U.S. Pat. No. 7,879,591].

For a detailed analysis of the total lipid content and composition in strain Y9502, a flask assay was conducted wherein cells were grown in 2 stages for a total of 7 days. Based on analyses, strain Y9502 produced 3.8 g/L DCW, 37.1 TFAs % DCW, 21.3 EPA % DCW, and the lipid profile was as follows, wherein the concentration of each fatty acid is as a weight percent of TFAs ["% TFAs"]: 16:0 (palmitate)—2.5, 16:1 (palmitoleic acid)—0.5, 18:0 (stearic acid)—2.9, 18:1 (oleic acid)—5.0, 18:2 (LA)—12.7, ALA—0.9, EDA-3.5, DGLA—3.3, ARA—0.8, ETrA—0.7, ETA—2.4, EPA—57.0, other—7.5.

Generation of *Yarrowia lipolytica* Strain Z1978 from Strain Y9502

The development of strain Z1978 from strain Y9502 is shown in FIG. 7 and described in U.S. Provisional Appl. No. 61/377,248, filed Aug. 26, 2010), hereby incorporated herein by reference.

Figure 8B:
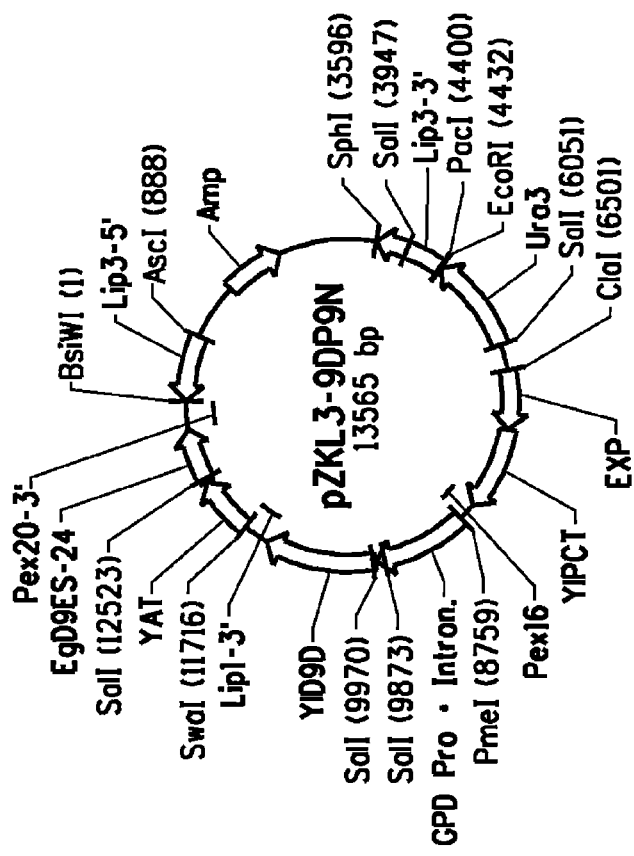
Figure 8A:
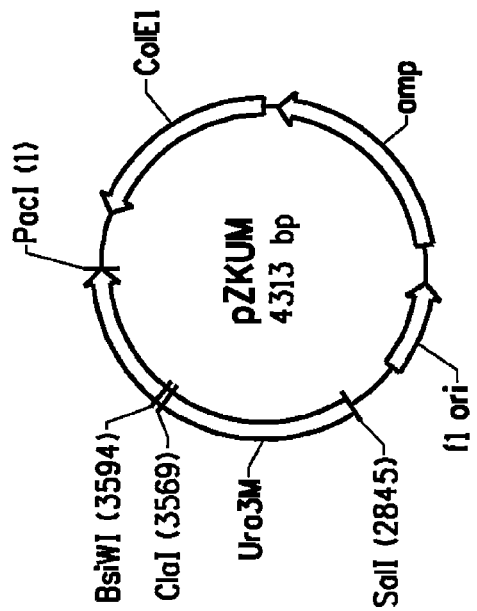

Specifically, to disrupt the Ura3 gene in strain Y9502, SalI/PacI-digested construct pZKUM (FIG. 8A; SEQ ID NO:218; described in Table 15 of U.S. Pat. Appl. Pub. No. 2009-0093543-A1, hereby incorporated herein by reference) was used to integrate an Ura3 mutant gene into the Ura3 gene of strain Y9502, according to the General Methods. A total of 27 transformants (selected from a first group comprising 8 transformants, a second group comprising 8 transformants, and a third group comprising 11 tranformants) were grown on Minimal Media+5-fluoroorotic acid ["MM+5-FOA"] selection plates and maintained at 30° C. for 2 to 5 days. Further experiments determined that only the third group of transformants possessed a real Ura− phenotype.

The Ura− cells were scraped from the MM+5-FOA plates and subjected to fatty acid analysis, according to the General Methods. In this way, GC analyses showed that there were 28.5%, 28.5%, 27.4%, 28.6%, 29.2%, 30.3% and 29.6% EPA of TFAs in pZKUM-transformants #1, #3, #6, #7, #8, #10 and #11 of group 3, respectively. These seven strains were designated as strains Y9502U12, Y9502U14, Y9502U17, Y9502U18, Y9502U19, Y9502U21 and Y9502U22, respectively (collectively, Y9502U).

Construct pZKL3-9DP9N (FIG. 8B; SEQ ID NO:219) was generated to integrate one delta-9 desaturase gene, one choline-phosphate cytidylyl-transferase gene, and one delta-9 elongase mutant gene into the *Yarrowia* YALI0F32131p locus (GenBank Accession No. XM_506121) of strain Y9502U. The pZKL3-9DP9N plasmid contained the following components:

TABLE 12

| Description of Plasmid pZKL3-9DP9N (SEQ ID NO: 219) | |
| --- | --- |
| RE Sites And Nucleotides Within SEQ ID NO: 219 | Description Of Fragment And Chimeric Gene Components |
| AscI/BsiWI (887-4) | 884 bp 5' portion of YALI0F32131p locus (GenBank Accession No. XM_506121, labeled as "Lip3-5" in Figure) |

TABLE 12-continued

Description of Plasmid pZKL3-9DP9N (SEQ ID NO: 219)

| RE Sites And Nucleotides Within SEQ ID NO: 219 | Description Of Fragment And Chimeric Gene Components |
|---|---|
| PacI/SphI (4396-3596) | 801 bp 3' portion of YALI0F32131p locus (GenBank Accession No. XM_506121, labeled as "Lip3-3" in Figure) |
| SwaI/BsiWI (11716-1) | YAT1::EgD9eS-L35G::Pex20, comprising: YAT1: *Yarrowia lipolytica* YAT1 promoter (labeled as "YAT" in Figure; U.S. Pat. application Pub. No. 2010-0068789-A1); EgD9eS-L35G: Synthetic mutant of delta-9 elongase gene (SEQ ID NO: 220; U.S. Provisional Pat. No. 61/377248), derived from *Euglena gracilis* ("EgD9eS"; U.S. Pat. No. 7,645,604) (labeled as "EgD9ES-24" in Figure); Pex20: Pex20 terminator sequence from *Yarrowia* Pex20 gene (GenBank Accession No. AF054613) |
| PmeI/SwaI (8759-11716) | GPDIN::YID9::Lip1, comprising: GPDIN: *Yarrowia lipolytica* GPDIN promoter (U.S. Pat. No. 7,459,546; labeled as "GPDPro+Intron" in Figure); YID9: *Yarrowia lipolytica* delta-9 desaturase gene (GenBank Accession No. XM_501496; SEQ ID NO: 222); Lip1: Lip1 terminator sequence from *Yarrowia* Lip1 gene (GenBank Accession No. Z50020) |
| ClaI/PmeI (6501-8759) | EXP1::YIPCT::Pex16, comprising: EXP1: *Yarrowia lipolytica* export protein (EXP1) promoter (labeled as "EXP" in Figure; U.S. Pat. No. 7,932,077); YIPCT: *Yarrowia lipolytica* choline-phosphate cytidylyl-transferase ["PCT"] gene (GenBank Accession No. XM_502978; SEQ ID NO: 224); Pex16: Pex16 terminator sequence from *Yarrowia* Pex16 gene (GenBank Accession No. U75433) |
| SalI/EcoRI (6501-4432) | *Yarrowia* Ura3 gene (GenBank Accession No. AJ306421) |

The pZKL3-9DP9N plasmid was digested with AscI/SphI and then used for transformation of strain Y9502U17, according to the General Methods. The transformant cells were plated onto MM plates and maintained at 30° C. for 3 to 4 days. Single colonies were re-streaked onto MM plates and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, supra.

GC analyses showed that most of the selected 96 strains of Y9502U17 with pZKL3-9DP9N produced 50-56% EPA of TFAs. Five strains (i.e., #31, #32, #35, #70 and #80) that produced about 59.0%, 56.6%, 58.9%, 56.5%, and 57.6% EPA of TFAs were designated as Z1977, Z1978, Z1979, Z1980 and Z1981, respectively.

The final genotype of these pZKL3-9DP9N transformant strains with respect to wildtype *Yarrowia lipolytica* ATCC #20362 was Ura+, Pex3–, unknown 1-, unknown 2-, unknown 3-, unknown 4-, unknown 5-, unknown6-, unknown 7-, unknown 8-, unknown9-, unknown 10-, unknown 11-, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, YAT::EgD9eS-L35G::Pex20, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPDIN::YID9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, GPDIN::EgD5SM::Aco, GPM::EgD5SM::Oct, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, YAT1::MCS::Lip1, FBA::MCS::Lip1, YAT1::MaLPAAT1S::Pex16, EXP1::YIPCT::Pex16.

Knockout of the YALI0F32131p locus (GenBank Accession No. XM_50612) in strains Z1977, Z1978, Z1979, Z1980 and Z1981 was not confirmed in any of these EPA strains produced by transformation with pZKL3-9DP9N.

Cells from YPD plates of strains Z1977, Z1978, Z1979, Z1980 and Z1981 were grown and analyzed for total lipid content and composition (supra). Table 13 below summarizes the total DCW, the tTFAs % DCW, the concentration of each fatty acid as a weight percent of TFAs ["% TFAs"] and the EPA % DCW of strains Z1977, Z1978, Z1979, Z1980 and Z1981, as determined by flask assays. Fatty acids are 16:0 (palmitate), 16:1 (palmitoleic acid), 18:0 (stearic acid), 18:1 (oleic acid), 18:2 (linoleic acid), ALA (α-linolenic acid), EDA (eicosadienoic acid), DGLA (dihomo-γ-linolenic acid), ARA (arachidonic acid), EtrA (eicosatrienoic acid), ETA (eicosatetraenoic acid), EPA (eicosapentaenoic acid) and other.

TABLE 13

Total Lipid Content And Composition In *Yarrowia* Strains Z1977, Z1978, Z1979, Z1980 and Z1981 By Flask Assay

| Strain | DCW (g/L) | TFAs % DCW | % TFAs 16:0 | 16:1 | 18:0 | 18:1 | 18:2 | ALA | EDA | DGLA | ARA | EtrA | ETA | EPA | other | EPA % DCW |
|---|---|---|---|---|---|---|---|---|---|---|---|---|---|---|---|---|
| Z1977 | 3.8 | 34.3 | 2.0 | 0.5 | 1.9 | 4.6 | 11.2 | 0.7 | 3.1 | 3.3 | 0.9 | 0.7 | 2.2 | 59.1 | 9.9 | 20.3 |
| Z1978 | 3.9 | 38.3 | 2.4 | 0.4 | 2.4 | 4.8 | 11.1 | 0.7 | 3.2 | 3.3 | 0.8 | 0.6 | 2.1 | 58.7 | 9.5 | 22.5 |
| Z1979 | 3.7 | 33.7 | 2.3 | 0.4 | 2.4 | 4.1 | 10.5 | 0.6 | 3.2 | 3.6 | 0.9 | 0.6 | 2.2 | 59.4 | 9.8 | 20.0 |
| Z1980 | 3.6 | 32.7 | 2.1 | 0.4 | 2.2 | 4.0 | 10.8 | 0.6 | 3.1 | 3.5 | 0.9 | 0.7 | 2.2 | 59.5 | 10.0 | 19.5 |
| Z1981 | 3.5 | 34.3 | 2.2 | 0.4 | 2.1 | 4.2 | 10.6 | 0.6 | 3.3 | 3.4 | 1.0 | 0.8 | 2.2 | 58.5 | 10.7 | 20.1 |

Subsequent to the filing of U.S. Provisional Appl. No. 61/377,248, filed Aug. 26, 2010), strain Z1978 was subjected to partial genome sequencing. This work determined that instead of six delta-5 desaturase genes integrated into the *Yarrowia* genome, the engineered strain actually possessed only four.

More specifically, two separate plasmid fragments (or portions thereof) were not detected in strain Z1978, as described further below.

(1) Construct pZKL2-5 mB89C (see U.S. Pat. Appl. Pub. No. 2010-0317072-A1, SEQ ID NO:131 therein) was intended to integrate one delta-5 desaturase gene into the Lip2 loci of strain Y8069U. However, sequencing of the genome failed to detect the Lip2.3N end portion of the pZKL2-5 mB89C fragment and the GPDIN::EgD5SM::Aco chimeric gene. DNA re-arrangement could have resulted in loss of the GPDIN::EgD5SM::Aco cassette during the generation of the Y8154 strain (FIG. 7).

(2) Construct pZKL1-2SR9G85 (see U.S. Pat. Appl. Pub. No. 2010-0317072-A1, SEQ ID NO:132 therein) was intended to integrate one delta-5 desaturase gene into the Lip1 loci of strain Y8154U1. However, neither genome sequencing nor PCR amplification was able to detect the delta-5 desaturase gene in strain Z1978. DNA re-arrangement could have resulted in loss of the GPM::EgD5SM::Oct cassette during the generation of strain Y8269 (FIG. 7).

Additionally, it was determined that construct pZSCP-Ma83 (see U.S. Pat. Appl. Pub. No. 2010-0317072-A1, SEQ ID NO:133 therein) and construct pZP2-85 m98F (see U.S. Pat. Appl. Pub. No. 2010-0317072-A1, SEQ ID NO:135 therein) both integrated into the YALI0B21890g locus.

Thus, the true genotype of strain Z1978 with respect to wildtype Yarrowia lipolytica ATCC #20362 was as follows: Ura+, Pex3-, unknown 1-, unknown 2-, unknown 3-, unknown 4-, YALI0E12947g-, unknown6-, YALI0821890g-, unknown 8-, unknown 10-, unknown 11-, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, YAT1::EgD9eS-L35G::Pex20, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPDIN::YID9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, YAT1::MCS::Lip1, FBA::MCS::Lip1, YAT1::MaLPAAT1S::Pex16, EXP1::YIPCT::Pex16.

Example 15

Generation of Yarrowia lipolytica Strains Comprising Double Delta-5 Desaturase Mutants and Producing More than 50 EPA % TFAs The present Example describes the construction of a suite of strains, derived from Yarrowia lipolytica strain Z1978 (Example 14), capable of producing more than 50 EPA % TFAs with more than 35 TFAs % DCW via expression of a delta-9 elongase/delta-8 desaturase pathway. The EPA strains included the following mutant delta-5 desaturases comprising double mutations in both the HPGG (SEQ ID NO:7) and HDASH (SEQ ID NO:8) motifs: EgD5S-36s157g (SEQ ID NO:183; Example 12) and EaD5S-35a158g (SEQ ID NO:213; Example 13), as well as either EgD5M (i.e., EgD5R*-34g158g; SEQ ID NO:153; Examples 9 and 11) or EgD5M1 (i.e., EgD5R*-34g158g347s; SEQ ID NO:157; Examples 10 and 11).

The strains were generated in a two-step method as shown in FIG. 9, wherein the original delta-5 desaturase genes in strain Z1978 were first deleted to result in strains Y0S9017 (Ura–) and Y0S9019 (Ura–) which produced at least about 56% ETA, but were no longer capable of producing EPA. Then, the double mutant delta-5 desaturases supra were integrated into the chromosome of strains Y0S9017 (Ura–) and Y0S9019 (Ura–), thereby restoring the ability of the transformant strains to produce EPA.

More specifically, the four delta-5 desaturase genes in strain Z1978 were originally integrated into the chromosome from two different constructs: pZKSL-5S5A5 (SEQ ID NO:226; see also U.S. Pat. Appl. Pub. No. 2010-0317072-A1, FIG. 4A and Table 6 therein) comprised chimeric EXP1::EgD5M::Pex16, FBAIN::EgD5SM::Pex20 and YAT1::EaD5SM::OCT genes, while pZP2-85m98F (SEQ ID NO:227; see also U.S. Pat. Appl. Pub. No. 2010-0317072-A1, FIG. 7B and Table 13 therein) comprised a chimeric EXP1::EgD5SM::Lip1 gene. Three separate homologous recombination events were required to remove these four chimeric genes.

First, the chimeric FBAIN::EgD5SM::Pex20 gene and a large portion of the Leu gene (i.e., from pZKSL-555A5) in the genome of strain Z1978U was replaced by homologous recombination (FIG. 10A) with a 993 bp stuffer DNA fragment (SEQ ID NO:228) within plasmid pYPS234 (FIG. 10B; SEQ ID NO:229), wherein the 993 bp stuffer comprised 5' and 3' portions of the Yarrowia carnitine/acyl carnitine carrier gene. More specifically, the pYSP234 plasmid contained the following components.

TABLE 14

Description of Plasmid pYPS234 (SEQ ID NO: 229)

| RE Sites And Nucleotides Within SEQ ID NO: 229 | Description Of Fragment And Chimeric Gene Components |
|---|---|
| Swa I/Pac I (1-1498) | Yarrowia Ura3 gene (GenBank Accession No. AJ306421) |
| 2494-3354 | Ampicillin-resistance gene for selection in E. coli |
| BsiW I/Pme I (4239-4964) | YAT1: Yarrowia lipolytica YAT1 promoter (labeled as "YAT" in Figure; U.S. Pat. application Pub. No. 2010-0068789-A1) |
| 4968-5320 | Leu fragment: 353 bp fragment of Leu2 gene (GenBank Accession No. AF260230) |
| 5327-6319 | 180 Stuffier: 993 bp DNA fragment (SEQ ID NO: 228), comprising 5' and 3' portions of Yarrowia carnitine/acyl carnitine carrier gene (GenBank Accession No XP_501358) |
| Bam HI/Bsi WI | Pex20: Pex20 terminator sequence from Yarrowia Pex20 gene (GenBank Accession No. AF054613 |
| Hind III/Swa I (6638-7338) | Lys5-5': 720 bp 5' portion of Yarrowia Lys5 gene (GenBank Accession No. M34929; labeled as "lys5 5' region" in Figure) |

The first crossover event occurred within the Lys5-5' DNA fragment, while the second crossover event occurred within the YAT1 promoter region. Strain YOS9001 was generated from this homologous recombination, having a Leu–, Ura– phenotype and three delta-5 desaturase genes within its genome.

Then, the chimeric EXP1::EgD5M::Pex16 and YAT1::EaD5SM::OCT genes in the genome of strain YOS9001 were replaced by homologous recombination (FIG. 11A) with a 1019 bp stuffer DNA fragment (SEQ ID NO:230) within plasmid pYPS233 (FIG. 11B; SEQ ID NO:231), wherein the 1019 bp stuffer comprised 5' and 3' portions of the Yarrowia ALK2 gene. The pYSP233 plasmid contained the following components:

TABLE 15

Description of Plasmid pYPS233 (SEQ ID NO: 231)

| RE Sites And Nucleotides Within SEQ ID NO: 231 | Description Of Fragment And Chimeric Gene Components |
|---|---|
| Swa I/Pac I (1-1498) | Yarrowia Ura3 gene (GenBank Accession No. AJ306421) |
| 2494-3354 | Ampicillin-resistance gene for selection in E. coli |
| Sph I/Pac I (4214-4901) | Lys5-3: 684 bp 3' portion of Yarrowia Lys5 gene (GenBank Accession No. M34929; labeled as "Lys5-3' region" in Figure) |
| MluI/BsiWI (5229-6263) | 171 stuffer: 1019 bp DNA fragment (SEQ ID NO: 230), comprising 5' and 3 portions of the Yarrowia ALK2 gene (GenBank Accession No. BAA31434) |
| BsiWI/Pme I (6263-6988) | YAT1: Yarrowia lipolytica YAT1 promoter (U.S. Pat. application Pub. No. 2010-0068789-A1) |
| Pme I/Swa I (6988/1) | Leu fragment: 353 bp fragment of Leu2 gene (GenBank Accession No. AF260230) |

The first crossover event occurred within the Lys5-3' DNA fragment, while the second crossover event occurred within either the 3' Leu or YAT1 promoter region. Strains YOS9006 and YOS9009 (corresponding to two separate colonies having identical genotypes) were generated from this homologous recombination, each having a Leu–, Ura– phenotype and one delta-5 desaturase gene within the genome.

Finally, the chimeric EXP1::EgD5SM::Lip1 gene in the genomes of strain YOS9006 and YOS9009 was replaced by homologous recombination (FIG. 12A) with a functional Leu2 gene within plasmid of pYSP241 (FIG. 12B; SEQ ID NO:232). The pYSP241 plasmid contained the following components:

TABLE 16

Description of Plasmid pYPS241 (SEQ ID NO: 232)

| RE Sites And Nucleotides Within SEQ ID NO: 232 | Description Of Fragment And Chimeric Gene Components |
|---|---|
| ClaI/PmeI (1-2134) | LeuL: Yarrowia Leu2 gene encoding isopropylmalate dehydrogenase (GenBank Accession No. AF260230) |
| SwaI/PmeI (3893-2134) | EaD8S::Pex20, comprising: EaD8S: Synthetic delta-8 desaturase derived from Euglena anabaena (U.S. Pat. No. 7,790,156), codon-optimized for expression in Yarrowia lipolytica ("EaD8S"); Pex20: Pex20 terminator sequence from Yarrowia Pex20 gene (GenBank Accession No. AF054613) |
| SphI/ClaI (8107-9209) | B21890 arm A: Upstream DNA sequence of Yarrowia ORF B21890 (GenBank Accession XP_501199). |

The first crossover event occurred in the region between position 2870148 and 2871250 of chromosome B, while the second crossover event occurred in the EaD8S region of plasmid pYSP241, thereby generating strains YOS9017 (Ura–) and YOS9019 (Ura–). Strains YOS9017 and YOS9019 (corresponding to two separate colonies having identical genotypes) were generated from this homologous recombination, each having a Ura– phenotype and no delta-5 desaturase genes within the genome.

To analyze the fatty acid composition and oil content of strains YOS9001 (Leu–, Ura–), YOS9006 (Leu–, Ura–), YOS9009 (Leu–, Ura–), YOS9017 (Ura–), YOS9019 (Ura–) and the Z1978U (Ura–) control, triplicate flask assays (identified as samples "A", "B" and "C") were carried out according to the methodology of Example 14.

Table 17 summarizes the concentration of each fatty acid as a weight percent of TFAs ["% TFAs"]. Fatty acids are as in Table 13, while 20:4 (5,11,14,17) refers to juniperonic acid. The sum of all fatty acids in each sample totaled 100.

Table 18 summarizes the total dry DCW, the TFAs % DCW, and the EPA % DCW.

TABLE 17

Fatty Acid Composition In Yarrowia Strains YOS9001, YOS9006, YOS9009, YOS9017, YOS9019 And Z1978U

| Strain (# of Δ5 Desaturase Genes) | Sample | % TFAs | | | | | | | | | | | | |
|---|---|---|---|---|---|---|---|---|---|---|---|---|---|---|
| | | 16:0 | 16:1 | 18:0 | 18:1 | 18:2 | ALA | EDA | DGLA | ARA | ETrA | 20:4 (5, 11, 14, 17) | ETA | EPA | Other |
| YOS9001 | A | 2.2 | 0.5 | 1.5 | 2.2 | 7.9 | 0.0 | 2.4 | 5.1 | 1.3 | 0.5 | 0.5 | 2.8 | 58.2 | 14.8 |
| (3 Δ5 | B | 2.3 | 0.5 | 1.4 | 2.3 | 8.1 | 0.0 | 2.5 | 5.0 | 1.4 | 0.4 | 0.7 | 2.8 | 57.7 | 14.8 |
| genes) | C | 2.6 | 0.5 | 1.5 | 2.3 | 8.4 | 0.0 | 2.5 | 4.8 | 1.5 | 0.4 | 0.6 | 2.8 | 56.9 | 15.1 |
| | Avg | 2.4 | 0.5 | 1.5 | 2.3 | 8.2 | 0.0 | 2.5 | 5.0 | 1.4 | 0.4 | 0.6 | 2.8 | 57.6 | 14.9 |
| YOS9006 | A | 2.3 | 0.4 | 1.8 | 3.1 | 9.9 | 0.5 | 3.1 | 7.9 | 0.9 | 0.4 | 0.3 | 6.3 | 53.1 | 9.9 |
| (1 Δ5 | B | 2.3 | 0.4 | 1.8 | 3.1 | 10.0 | 0.6 | 3.1 | 7.8 | 1.0 | 0.4 | 0.3 | 6.2 | 52.9 | 10.1 |
| gene) | C | 2.2 | 0.5 | 1.8 | 3.3 | 10.2 | 0.5 | 3.2 | 7.9 | 1.0 | 0.4 | 0.4 | 6.3 | 52.6 | 9.9 |
| | Avg | 2.3 | 0.4 | 1.8 | 3.2 | 10.0 | 0.5 | 3.2 | 7.9 | 1.0 | 0.4 | 0.3 | 6.3 | 52.9 | 10.0 |
| YOS9009 | A | 2.1 | 0.4 | 1.8 | 2.9 | 9.9 | 0.5 | 2.8 | 8.8 | 1.0 | 0.4 | 0.4 | 7.3 | 51.6 | 10.1 |
| (1 Δ5 | B | 2.1 | 0.4 | 1.8 | 2.9 | 9.9 | 0.3 | 2.6 | 8.6 | 1.0 | 0.4 | 0.3 | 7.3 | 52.2 | 10.2 |
| gene) | C | 2.0 | 0.5 | 1.7 | 2.8 | 9.7 | 0.3 | 2.5 | 8.8 | 1.0 | 0.4 | 0.3 | 7.4 | 52.1 | 10.5 |
| | Avg | 2.1 | 0.4 | 1.8 | 2.9 | 9.8 | 0.3 | 2.7 | 8.7 | 1.0 | 0.4 | 0.4 | 7.3 | 52.0 | 10.3 |
| YOS9017 | A | 2.3 | 1.0 | 2.4 | 6.5 | 10.7 | 0.7 | 3.7 | 10.0 | 0.1 | 0.7 | 0.0 | 56.6 | 0.0 | 5.0 |
| (zero Δ5 | B | 2.4 | 0.9 | 2.4 | 6.6 | 10.7 | 0.8 | 3.6 | 9.8 | 0.2 | 0.7 | 0.0 | 55.7 | 0.0 | 6.0 |
| genes) | C | 2.3 | 0.9 | 2.4 | 6.6 | 10.6 | 0.7 | 3.6 | 9.9 | 0.2 | 0.7 | 0.0 | 56.1 | 0.0 | 6.0 |
| | Avg | 2.3 | 0.9 | 2.4 | 6.6 | 10.6 | 0.7 | 3.6 | 9.9 | 0.2 | 0.7 | 0.0 | 56.1 | 0.0 | 5.7 |
| YOS9019 | A | 2.1 | 0.9 | 2.3 | 6.9 | 10.7 | 0.8 | 3.8 | 9.5 | 0.2 | 0.8 | 0.0 | 56.3 | 0.0 | 5.7 |
| (zero Δ | B | 2.1 | 0.9 | 2.2 | 6.8 | 10.7 | 0.8 | 3.7 | 9.6 | 0.2 | 0.8 | 0.0 | 56.5 | 0.0 | 5.6 |
| genes) | C | 2.1 | 0.9 | 2.3 | 7.0 | 10.8 | 0.8 | 3.8 | 9.4 | 0.1 | 0.8 | 0.0 | 56.2 | 0.0 | 5.8 |
| | Avg | 2.1 | 0.9 | 2.3 | 6.9 | 10.7 | 0.8 | 3.8 | 9.5 | 0.2 | 0.8 | 0.0 | 56.3 | 0.0 | 5.7 |
| Z1978U | A | 2.4 | 0.6 | 2.8 | 6.6 | 13.4 | 0.9 | 4.8 | 3.4 | 0.7 | 0.9 | 0.8 | 2.6 | 52.3 | 7.9 |
| (4 Δ5 | B | 2.4 | 0.6 | 2.8 | 6.5 | 13.4 | 0.9 | 4.8 | 3.4 | 0.8 | 1.0 | 0.8 | 2.6 | 52.2 | 7.8 |
| genes) | C | 2.4 | 0.6 | 2.8 | 6.6 | 13.4 | 0.9 | 4.8 | 3.4 | 0.8 | 0.9 | 0.8 | 2.6 | 52.3 | 7.8 |
| | Avg | 2.4 | 0.6 | 2.8 | 6.6 | 13.4 | 0.9 | 4.8 | 3.4 | 0.8 | 0.9 | 0.8 | 2.6 | 52.3 | 7.8 |

TABLE 18

Total Lipid Content In *Yarrowia* Strains YOS9001, YOS9006, YOS9009, YOS9017, YOS9019 And Z1978U

| Strain (# of Δ5 Desaturase Genes) | Sample | DCW (g/L) | Fame (% DCW) | EPA (% DCW) |
|---|---|---|---|---|
| YOS9001 | A | 1.16 | 15.9 | 9.3 |
| (3 Δ5 | B | 1.25 | 15.1 | 8.7 |
| genes) | C | 1.44 | 15.0 | 8.5 |
|  | Avg | 1.28 | 15.3 | 8.8 |
| YOS9006 | A | 1.88 | 18.9 | 10.1 |
| (1 Δ5 | B | 1.97 | 18.8 | 10.0 |
| gene) | C | 1.98 | 18.9 | 9.9 |
|  | Avg | 1.94 | 18.9 | 10.0 |
| YOS9009 | A | 1.82 | 19.3 | 9.9 |
| (1 Δ5 | B | 1.90 | 18.3 | 9.6 |
| gene) | C | 1.82 | 18.6 | 9.7 |
|  | Avg | 1.85 | 18.7 | 9.7 |
| YOS9017 | A | 4.4 | 27.9 | 0.0 |
| (zero Δ5 | B | 4.4 | 28.2 | 0.0 |
| genes) | C | 4.5 | 28.3 | 0.0 |
|  | Avg | 4.44 | 28.1 | 0.0 |
| YOS9019 | A | 4.5 | 30.3 | 0.0 |
| (zero Δ5 | B | 5.0 | 29.9 | 0.0 |
| genes) | C | 4.6 | 29.3 | 0.0 |
|  | Avg | 4.69 | 29.8 | 0.0 |
| Z1978U | A | 5.4 | 34.1 | 17.8 |
| (4 Δ5 | B | 5.4 | 33.9 | 17.7 |
| genes) | C | 5.4 | 33.3 | 17.4 |
|  | Avg | 5.40 | 33.8 | 17.7 |

The data of the flask experiment demonstrated that strain YOS9001 (Leu–, Ura–), comprising three delta-5 desaturase genes within the genome, produced about 57 EPA % TFAs, while strains YOS9006 (Leu–, Ura–) and YOS9009 (Leu–, Ura–), comprising only one delta-5 desaturase gene in their genomes, produced about 52.0 EPA % TFAs. In contrast, strains YOS9017 (Ura–) and YOS9019 (Ura–) were not able to produce any EPA but did produce about 56% ETA. The lack of delta-5 desaturase activity in strains YOS9017 (Ura–) and YOS9019 (Ura–) was validated by the total fatty acid analysis above; PCR analyses also confirmed the lack of any DNA sequence encoding a delta-5 desaturase.

Figures 13A, 13B:
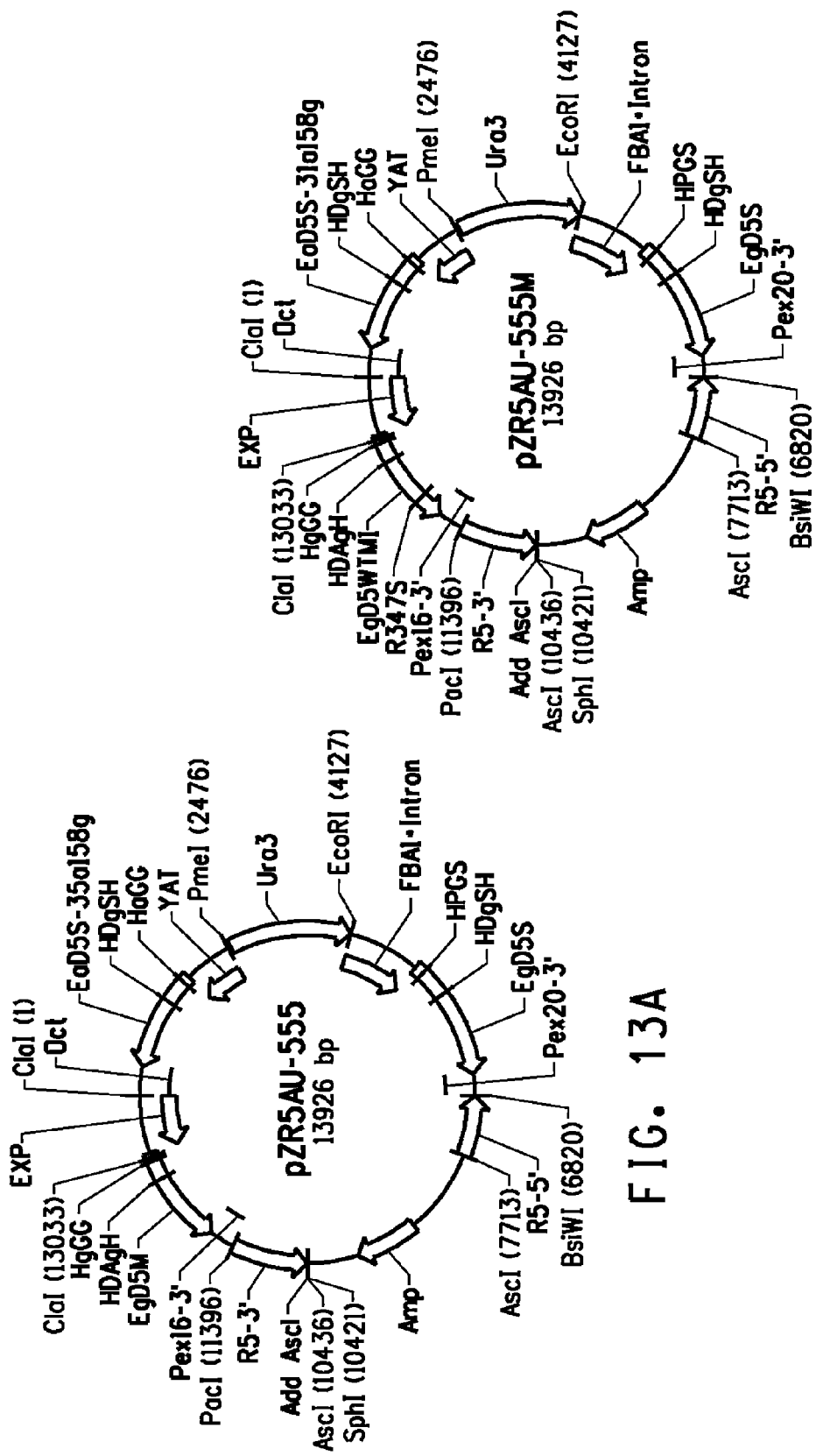

Construct pZR5AU-555 (FIG. 13A; SEQ ID NO:233) was generated to integrate three chimeric mutant delta-5 desaturase genes (i.e., FBAIN::EgD5S-36s157g::Pex20 [Example 12], YAT1::EaD5S-35a158g::Oct [Example 13], and EXP1::EgD5M (EgD5R*-34g158g)::Pex16 [Examples 9 and 11] into the region between 1685392 and 1687267 of chromosome C of strain YOS9017 and YOS9019, to thereby enable production of EPA.

The pZR5AU-555 plasmid contained the following components:

TABLE 19

Description of Plasmid pZR5AU-555 (SEQ ID NO: 233)

| RE Sites And Nucleotides Within SEQ ID NO: 233 | Description Of Fragment And Chimeric Gene Components |
|---|---|
| AscI/BsiWI (7713-6820) | 890 bp DNA fragment between 1685392 and 1686281 of *Yarrowia* chromosome C (labeled as "R5-5' region" in Figure) |
| PacI/AscI (11396-10436) | 967 bp DNA fragment between 1686300 and 1687260 of *Yarrowia* chromosome C (labeled as "R5-3' region" in Figure) |
| PmeI/ClaI (2476-1) | YAT1::EaD5S-35a158g::Oct, comprising: YAT1: *Yarrowia lipolytica* YAT1 promoter (labeled as "YAT" in Figure; U.S. Pat. application Pub. No. 2010-0068789-A1); |
| | EaD5S-35a158g: Synthetic mutant delta-5 desaturase comprising mutant HaGG [SEQ ID NO: 14] and HDgSH [SEQ ID NO: 15] motifs (SEQ ID NO: 212), derived from *Euglena anabaena*; OCT: OCT terminator sequence of *Yarrowia* OCT gene (GenBank Accession No. X69988) |
| EcoRI/BsiWI (4127-6820) | FBAIN::EgD5S-36s157g::Pex20, comprising: FBAIN: *Yarrowia lipolytica* FBAIN promoter (labeled as "FBA1+Intron" in Figure; U.S. Pat. No. 7,202,356); EgD5S-36s157g: Synthetic mutant delta-5 desaturase comprising mutant HPGs [SEQ ID NO: 11] and HDgSH [SEQ ID NO: 15] motifs (SEQ ID NO: 182), derived from *Euglena gracilis* (labeled as "EgD5S" in Figure); Pex20: Pex20 terminator sequence from *Yarrowia* Pex20 gene (GenBank Accession No. AF054613) |
| PacI/ClaI (11396-1) | EXP1::EgD5M (EgD5R-34g158g)::Pex16, comprising: EXP1: *Yarrowia lipolytica* export protein (EXP1) promoter (labeled as "EXP" in Figure; U.S. Pat. No. 7,932,077); EgD5M (EgD5R-34g158g): Synthetic mutant delta-5 desaturase comprising mutant HgGG [SEQ ID NO: 9] and HDAgH [SEQ ID NO: 18] motifs (SEQ ID NO: 152), derived from *Euglena gracilis* (labeled as "EgD5M" in Figure); Pex16: Pex16 terminator sequence from *Yarrowia* Pex16 gene (GenBank Accession No. U75433) |
| PmeI/EcoRI (2476-4127) | *Yarrowia* Ura3 gene (GenBank Accession No. AJ306421) |

Construct pZR5AU-555M (FIG. 13B; SEQ ID NO:234) was identical to pZR5AU-555, with the exception that the chimeric EXP1::EgD5M1 (EgD5R*-34g158g347s)::Pex16 gene [Examples 10 and 11] was used in place of the chimeric EXP1::EgD5M (EgD5R*-34g158g)::Pex16 gene of pZR5AU-555.

The pZR5AU-555 and pZR5AU-555M plasmids were digested separately with AscI and then used for transformation of strains YOS9017 and YOS9019 individually according to the General Methods. The transformant cells were plated onto MM plates and maintained at 30° C. for 4 to 5 days. Single colonies were then re-streaked onto MM plates and subsequently inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses of 96 pZR5AU-555 transformants into strain YOS9017 identified twenty strains (i.e., #9, #17, #22, #27, #31, #32, #42, #44, #46, #52, #53, #63, #68, #72, #74, #75, #77, #79, #80, #84 and #89) that produced more than 48% EPA of TFAs; these strains were designated as strains Z8001 to Z8020, respectively.

GC analyses of 82 pZR5AU-555M transformants into strain YOS9017 identified ten strains (i.e., #1, #27, #29, #33, #39, #41, #44, #49, #69 and #82) that produced more than 48% EPA of TFAs; these strains were designated as strains Z8021 to Z8030, respectively.

GC analyses of 84 pZR5AU-555 transformants into strain YOS9019 identified twelve strains (i.e., #28, #31, #39, #41, #42, #45, #63, #71, #73, #75, #78 and #84) that produced more than 48% EPA of TFAs; these strains were designated as strains Z8031 to Z8042, respectively.

And, GC analyses of 76 pZR5AU-555M transformants into strain YOS9019 identified twelve strains (i.e., #2, #24, #28, #30, #38, #46, #50, #66, #67, #69, #72 and #73) that produced more than 48% EPA of TFAs; these strains were designated as strains Z8043 to Z8054, respectively.

To analyze the fatty acid composition and oil content of these new EPA strains, duplicate flask assays were carried out for 13 representative strains (i.e., Z8001, Z8005, Z8007, Z8011, Z8014, Z8018, Z8020, Z8022, Z8024, Z8026, Z8035, Z8048 and Z8049). Table 20 summarizes the total DCW, the TFAs % DCW, the concentration of each fatty acid as a weight percent of TFAs ["% TFAs"] and the EPA (% DCW). Fatty acids are as in Table 13 and Table 17.

All 13 strains were capable of producing greater than 53 EPA % TFAs, with greater than 37 TFAs % DCW. Strains Z8024 and Z8035 produced 58.5 EPA % TFAs and 57.9 EPA % TFAs, with 40.8 TFAs % DCW and 37.8 TFAs % DCW, respectively.

(Cat. No. F553S, Finnzymes Oy, Finland) following the manufacturer's protocol. Products were separated by agarose gel electrophoresis and purified using the Zymoclean™ Gel DNA Recovery Kit (Zymo Research, Orange, Calif.), following the manufacturer's protocol, unless otherwise specified.

Introducing a HgGG (SEQ ID NO:9) Mutation into EgD5R Flanked by NotI Sites

A HgGG (SEQ ID NO:9) mutation was introduced into the EgD5R gene (SEQ ID NO:24) through two rounds of PCR amplification using plasmid pKR1032 as a DNA template. Plasmid pKR1032 was previously described in U.S. Pat. No. 7,678,560 and comprises the EgD5R gene (SEQ ID NO:24), flanked by NotI sites. The 5' end of EgD5R (SEQ ID NO:24) was amplified from pKR1032 with oligonucleotide primer EgD5-5 (SEQ ID NO:245) and primer EgD5 M1-3 (SEQ ID NO:246), designed to introduce a DNA change coding for a HgGG (SEQ ID NO:9) mutation. The 3' end of EgD5R (SEQ ID NO:24) was similarly amplified from vector pKR1032

TABLE 20

Fatty Acid Composition and Total Lipid Content In *Yarrowia* Strains Z8001, Z8005, Z8007, Z8011, Z8014, Z8018, Z8020, Z8022, Z8024, Z8026, Z8035, Z8048 and Z8049 Comprising Mutant Delta-5 Desaturases Simultaneously Comprising HxGx (SEQ ID NO: 34) and HDxxH (SEQ ID NO: 311) Mutant Motifs

| Sample | DCW (g/L) | TFAs % DCW | % Total Fatty Acids | | | | | | | | | | | | EPA % DCW |
|---|---|---|---|---|---|---|---|---|---|---|---|---|---|---|---|
| | | | 16:0 | 16:1 | 18:0 | 18:1 | 18:2 | ALA | EDA | DGLA | ARA | ETrA | 20:4 (5, 11, 14, 17) | ETA | EPA | |
| Z8001 | 4.0 | 41.2 | 2.4 | 0.5 | 2.7 | 4.8 | 11.5 | 0.6 | 2.7 | 5.0 | 1.0 | 0.0 | 0.6 | 3.8 | 54.6 | 22.5 |
| Z8005 | 3.7 | 41.5 | 2.5 | 0.5 | 2.6 | 4.6 | 11.5 | 0.6 | 2.6 | 5.7 | 1.0 | 0.0 | 0.6 | 4.6 | 53.4 | 22.2 |
| Z8007 | 3.7 | 41.2 | 2.6 | 0.5 | 2.9 | 4.7 | 11.4 | 0.7 | 2.6 | 5.7 | 0.9 | 0.0 | 0.6 | 4.8 | 53.1 | 21.9 |
| Z8011 | 4.0 | 41.7 | 2.4 | 0.6 | 3.5 | 5.8 | 11.9 | 0.8 | 3.4 | 3.1 | 0.8 | 1.0 | 0.9 | 2.9 | 53.4 | 22.2 |
| Z8014 | 3.8 | 37.8 | 2.4 | 0.5 | 2.6 | 4.5 | 11.3 | 0.6 | 2.6 | 5.3 | 1.0 | 0.0 | 0.6 | 4.1 | 54.9 | 20.8 |
| Z8018 | 3.2 | 40.8 | 2.4 | 0.4 | 2.6 | 4.5 | 11.3 | 0.6 | 2.7 | 6.1 | 0.9 | 0.0 | 0.6 | 4.9 | 53.4 | 21.8 |
| Z8020 | 3.2 | 41.3 | 2.4 | 0.4 | 2.7 | 4.5 | 11.4 | 0.6 | 2.6 | 5.9 | 0.9 | 0.0 | 0.6 | 4.9 | 53.7 | 22.1 |
| Z8022 | 3.1 | 41.5 | 2.4 | 0.4 | 2.6 | 4.3 | 11.2 | 0.6 | 2.7 | 5.2 | 1.0 | 0.0 | 0.6 | 3.7 | 55.5 | 23.0 |
| Z8024 | 3.2 | 40.8 | 2.5 | 0.4 | 2.6 | 4.4 | 11.6 | 0.6 | 3.0 | 2.5 | 1.2 | 0.0 | 1.4 | 1.4 | 58.5 | 23.9 |
| Z8026 | 3.1 | 40.8 | 2.4 | 0.4 | 2.7 | 4.4 | 11.2 | 0.6 | 2.7 | 5.6 | 1.0 | 0.0 | 0.6 | 4.2 | 54.5 | 22.3 |
| Z8035 | 3.0 | 37.8 | 2.3 | 0.5 | 2.2 | 4.6 | 11.7 | 0.7 | 3.2 | 3.9 | 0.7 | 0.5 | 0.4 | 2.7 | 57.9 | 21.9 |
| Z8048 | 3.9 | 37.4 | 2.3 | 0.5 | 2.4 | 4.8 | 11.9 | 0.6 | 3.0 | 5.0 | 1.1 | 0.3 | 0.7 | 3.7 | 54.4 | 20.3 |
| Z8049 | 3.7 | 37.5 | 2.3 | 0.5 | 2.3 | 4.4 | 11.4 | 0.6 | 2.6 | 6.0 | 1.0 | 0.0 | 0.7 | 4.9 | 53.8 | 20.2 |

Example 16

Generation of HgGG (SEQ ID NO:9) and HDAxH (SEQ ID NO:37) Mutations in the Variant *Euglena gracilis* Delta-5 Desaturase ["EgD5R"] for Cloning into Plant Expression Vectors Table 7 of Example 7 summarizes the delta-5 desaturase activity from various EgD5R* variants which comprise mutations that alter both the HPGG (SEQ ID NO:7) and HDASH (SEQ ID NO:8) motifs. In Table 7, the EgD5R* proteins having either modified HgGG (SEQ ID NO:9) and HDAgH (SEQ ID NO:18) motifs (as in EgD5R*-34g158g; SEQ ID NO:143) or modified HgGG (SEQ ID NO:9) and HDAaH (SEQ ID NO:17) motifs (as in EgD5R*-34g158a; SEQ ID NO:141) have at least 88% of the activity of the EgD5R* protein (which is identical to the EgD5R protein).

The present Example describes methods used to introduce similar mutations into the DNA sequence of EgD5R (SEQ ID NO:24), flanked by NotI sites for easy cloning into existing plant expression vectors (infra, Example 18), using PCR-based mutatgenesis with oligonucleotides that contain the desired nucleotide changes. More specifically, the double mutants were introduced into a delta-5 desaturase gene through two rounds of PCR amplification, each PCR performed using the Phusion™ High-Fidelity DNA Polymerase with oligonucleotide primer EgD5 M1-5 (SEQ ID NO:247), designed to introduce a DNA change coding for the HgGG (SEQ ID NO:9) mutation and being perfectly complementary to EgD5 M1-3 (SEQ ID NO:246), and primer EgD5-3 (SEQ ID NO:248). The resulting DNA fragments were separated and purified.

The two purified DNA fragments were then combined and the full-length gene having a DNA change coding for a HgGG (SEQ ID NO:9) mutation was amplified in a second round of PCR with oligonucleotide primers EgD5-5 (SEQ ID NO:245) and EgD5-3 (SEQ ID NO:248). The resulting DNA fragment was purified.

The full-length delta-5 desaturase DNA sequence comprising the HgGG (SEQ ID NO:9) motif is shown in SEQ ID NO:249, while the encoded protein is set forth as SEQ ID NO:250.

Combining a HgGG (SEQ ID NO:9) Mutation with a HDAgH (SEQ ID NO:18) Mutation in EgD5R Flanked by NotI Sites A HDAgH (SEQ ID NO:18) mutation was introduced into the DNA sequence encoding the delta-5 desaturase of SEQ ID NO:250 through two additional rounds of PCR amplification, using the methodologies described above and using the purified DNA fragment containing the HgGG (SEQ ID NO:9) mutation as template. Specifically, the 5' end of SEQ ID NO:249 was amplified with oligonucleotide primer EgD5-5

(SEQ ID NO:245) and primer EgD5 M2-3 (SEQ ID NO:251), designed to introduced a DNA change coding for a HDAgH (SEQ ID NO:18) mutation; the 3' end of SEQ ID NO:249 was amplified with oligonucleotide primer EgD5 M2-5 (SEQ ID NO:252), designed to introduce a DNA change coding for a HDAgH (SEQ ID NO:18) mutation and being perfectly complementary to EgD5 M2-3 (SEQ ID NO:251), and primer EgD5-3 (SEQ ID NO:248). The resulting DNA fragments were separated and purified, as described above.

The two purified DNA fragments were then combined and the full-length gene having a DNA change coding for a HgGG (SEQ ID NO:9) and a HDAgH (SEQ ID NO:18) mutation was amplified in a second round of PCR with oligonucleotide primers EgD5-5 (SEQ ID NO:245) and EgD5-3 (SEQ ID NO:248). The resulting PCR product was cloned into the pCR-Blunt® cloning vector using the Zero Blunt PCR Cloning Kit (Invitrogen Corporation), following the manufacturer's protocol, to produce pLF336 (SEQ ID NO:253).

The resulting delta-5 desaturase DNA sequence comprising a HgGG (SEQ ID NO:9) motif and a HDAgH (SEQ ID NO:18) motif in pLF336 is shown in SEQ ID NO:254, while the encoded protein is set forth as SEQ ID NO:255.

Combining a HgGG (SEQ ID NO:9) Mutation with a HDAaH (SEQ ID NO:17) Mutation In EqD5R Flanked by NotI Sites A HDAaH (SEQ ID NO:17) mutation was introduced into the DNA sequence encoding the delta-5 desaturase of SEQ ID NO:250 through two additional rounds of PCR amplification, using the methodologies described above and using the purified DNA fragment containing the HgGG (SEQ ID NO:9) mutation as template. Specifically, the 5' end of SEQ ID NO:249 was amplified with oligonucleotide primer EgD5-5 (SEQ ID NO:245) and primer EgD5 M3-3 (SEQ ID NO:256), designed to introduced a DNA change coding for the HDAaH (SEQ ID NO:17) mutation; the 3' end of SEQ ID NO:249 was similarly amplified with oligonucleotide primer EgD5 M3-5 (SEQ ID NO:257), designed to introduce a DNA change coding for the HDAaH (SEQ ID NO:17) mutation and being perfectly complementary to EgD5 M3-3 (SEQ ID NO:256), and primer EgD5-3 (SEQ ID NO:248). The resulting DNA fragments were separated and purified, as described above.

The two purified DNA fragments were then combined and the full-length gene having a DNA change coding for a HgGG (SEQ ID NO:9) and a HDAaH (SEQ ID NO:17) mutation was amplified in a second round of PCR with oligonucleotide primers EgD5-5 (SEQ ID NO:245) and EgD5-3 (SEQ ID NO:248). The resulting PCR product was cloned into the pCR-Blunt® cloning vector using the Zero Blunt® PCR Cloning Kit (Invitrogen Corporation), following the manufacturer's protocol, to produce pLF337 (SEQ ID NO:258).

The resulting delta-5 desaturase DNA sequence comprising a HgGG (SEQ ID NO:9) motif and a HDAaH (SEQ ID NO:17) motif in pLF337 is shown in SEQ ID NO:259, while the encoded protein is set forth as SEQ ID NO:260.

Example 17

Generation of HgGG (SEQ ID NO:9) and HDAxH (SEQ ID NO:37) Mutations in the *Euglena anabaena* Delta-5 Desaturase ["EaD5"] for Cloning into Plant Expression Vectors The present Example describes introduction of a HgGG (SEQ ID NO:9) mutation and either a HDAgH (SEQ ID NO:18) or a HDAaH (SEQ ID NO:17) mutation into the DNA sequence of EaD5 (SEQ ID NO:28) by PCR amplification, in an analogous manner as described in Example 16. The resulting genes were flanked by NotI sites to allow for cloning into a set of existing plant expression vectors (Example 18, infra); specifically, the double mutants were introduced into the delta-5 desaturase gene through two rounds of PCR amplification, each PCR performed using the Phusion™ High-Fidelity DNA Polymerase (Cat. No. F553S, Finnzymes Oy, Finland) following the manufacturer's protocol. Products were separated by agarose gel electrophoresis and purified using the Zymoclean™ Gel DNA Recovery Kit (Zymo Research, Orange, Calif.), following the manufacturer's protocol, unless otherwise specified.

Introducing a HgGG (SEQ ID NO:9) Mutation into EaD5 Flanked by NotI Sites

A HgGG (SEQ ID NO:9) mutation was introduced into the EaD5 gene (SEQ ID NO:28) through two rounds of PCR amplification using plasmid pKR1136 as a DNA template. Plasmid pKR1136 was previously described in U.S. Pat. Appl. Pub. No. 2008-0254191-A1 and comprises the EaD5 gene (SEQ ID NO:28) flanked by NotI sites. The 5' end of EaD5 (SEQ ID NO:28) was amplified from pKR1136 with oligonucleotide primer EaD5-5 (SEQ ID NO:261) and primer EaD5 M1-3 (SEQ ID NO:262), designed to introduced a DNA change coding for a HgGG (SEQ ID NO:9) mutation. The 3' end of EaD5 (SEQ ID NO:28) was similarly amplified from vector pKR1136 with oligonucleotide primer EaD5 M1-5 (SEQ ID NO:263), designed to introduce a DNA change coding for the HgGG (SEQ ID NO:9) mutation and being perfectly complementary to EaD5 M1-3 (SEQ ID NO:262), and EaD5-3 (SEQ ID NO:264). The resulting DNA fragments were separated and purified.

The two purified DNA fragments were then combined and the full-length gene having a DNA change coding for a HgGG (SEQ ID NO:9) mutation was amplified in a second round of PCR with oligonucleotide primers EaD5-5 (SEQ ID NO:261) and EaD5-3 (SEQ ID NO:264). The resulting DNA fragment was purified.

The resulting delta-5 desaturase DNA sequence comprising the HgGG motif (SEQ ID NO:9) is shown in SEQ ID NO:265, while the encoded protein is set forth as SEQ ID NO:266.

Combining a HgGG (SEQ ID NO:9) Mutation with a HDAgH (SEQ ID NO:18) Mutation in EaD5 Flanked by NotI Sites A HDAgH (SEQ ID NO:18) mutation was introduced into the DNA sequence encoding the delta-5 desaturase of SEQ ID NO:265 through two additional rounds of PCR amplification, using the methodologies described above and using the purified DNA fragment containing the HgGG (SEQ ID NO:9) mutation as template. The 5' end of SEQ ID NO:265 was amplified with oligonucleotide primer EaD5-5 (SEQ ID NO:261) and primer EaD5 M2-3 (SEQ ID NO:267), designed to introduced a DNA change coding for the HDAgH (SEQ ID NO:18) mutation; the 3' end of SEQ ID NO:265 was similarly amplified with oligonucleotide primer EaD5 M2-5 (SEQ ID NO:268), designed to introduce a DNA change coding for a HDAgH (SEQ ID NO:18) mutation and being perfectly complementary to EaD5 M2-3 (SEQ ID NO:267), and primer EaD5-3 (SEQ ID NO:264). The resulting DNA fragments were separated and purified, as described above.

The two purified DNA fragments were then combined and the full-length gene having a DNA change coding for a HgGG (SEQ ID NO:9) and a HDAgH (SEQ ID NO:18) mutation was amplified in a second round of PCR with oligonucleotide primers EaD5-5 (SEQ ID NO:261) and EaD5-3 (SEQ ID NO:264). The resulting PCR product was cloned into the pCR-Blunt® cloning vector using the Zero Blunt® PCR Cloning Kit (Invitrogen Corporation), following the manufacturer's protocol, to produce pLF338 (SEQ ID NO:269).

The resulting delta-5 desaturase DNA sequence comprising a HgGG (SEQ ID NO:9) motif and a HDAgH (SEQ ID NO:18) motif in pLF338 is shown in SEQ ID NO:270, while the encoded protein is set forth as SEQ ID NO:271.

Combining a HgGG (SEQ ID NO:9) Mutation with a HDAaH (SEQ ID NO:17) Mutation In EaD5 Flanked By NotI Sites A HDAaH mutation was introduced into the DNA sequence encoding the delta-5 desaturase of SEQ ID NO:270 through two additional rounds of PCR amplification and using the purified DNA fragment containing the HgGG (SEQ ID NO:9) mutation as template. The 5' end of SEQ ID NO:270 was amplified with oligonucleotide primer EaD5-5 (SEQ ID NO:261) and primer EaD5 M3-3 (SEQ ID NO:272), designed to introduced a DNA change coding for the HDAaH (SEQ ID NO:17) mutation; the 3' end of SEQ ID NO:270 was similarly amplified with oligonucleotide primer EaD5 M3-5 (SEQ ID NO:273), designed to introduce a DNA change coding for the HDAaH (SEQ ID NO:17) mutation and being perfectly complementary to EaD5 M3-3 (SEQ ID NO:272), and primer EaD5-3 (SEQ ID NO:264). The resulting DNA fragments were separated and purified, as described above.

The two purified DNA fragments were then combined and the full-length gene having a DNA change coding for a HgGG (SEQ ID NO:9) and a HDAaH (SEQ ID NO:17) mutation was amplified in a second round of PCR with oligonucleotide primers EaD5-5 (SEQ ID NO:261) and EaD5-3 (SEQ ID NO:264). The resulting PCR product was cloned into the pCR-Blunt® cloning vector using the Zero Blunt® PCR Cloning Kit (Invitrogen Corporation), following the manufacturer's protocol, to produce pLF339 (SEQ ID NO:274).

The resulting delta-5 desaturase DNA sequence comprising a HgGG (SEQ ID NO:9) motif and a HDAaH (SEQ ID NO:17) motif in in pLF339 is shown in SEQ ID NO:275, while the encoded protein is set forth as SEQ ID NO:276.

Example 18

Construction of Soybean Expression Vectors for Co-Expression of the EgD5R or EaD5 Double Delta-5 Desaturase Mutants with a Delta-9 Elongase and a Delta-8 Desaturase in Soy The present Example describes construction of soybean vectors for co-expression of the EgD5R or EaD5 double delta-5 desaturase mutants, comprising either HgGG (SEQ ID NO:9) and HDAgH (SEQ ID NO:18) motifs or HgGG (SEQ ID NO:9) and HDAaH (SEQ ID NO:17) motifs as described in Examples 16 and 17, respectively, with a suitable delta-9 elongase and delta-8 desaturase in soy.

The EgD5R mutants from pLF336 and pLF337 (described in Example 16), and the EaD5 mutants from pLF338 and pLF339 (described in Example 17) can be released from their respective vectors by digestion with NotI. This would then allow the delta-5 desaturase to readily be cloned into any number of existing soy expression vectors behind strong, seed-specific promoters.

For example, the NotI fragments comprising each of the mutated delta-5 desaturases can be cloned into the NotI fragment of pKR974, previously described in PCT Publication No. WO 2007/136877 (the contents of which are hereby incorporated by reference). In this way, the mutant delta-5 desaturases can be expressed behind the soy glycinin (Gy1) promoter for strong, seed-specific expression.

These vectors are then digested with SbfI and the fragments containing the mutated delta-5 desaturase are cloned into the SbfI site of pKR913, previously described in PCT Publication No. WO 2008/137516, the contents of which are hereby incorporated by reference. In this way, the mutated delta-5 desaturases can be co-expressed with the *Euglena gracilis* delta-8 desaturase ["EgD8"] and the *E. gracilis* delta-9 elongase ["EgD9e"] behind strong, seed-specific promoters.

Any of the vectors thus generated are purified and either the vector or an AscI fragment of the vector is co-transformed with vectors designed to increase omega-3 PUFAs, such as, but not limited to, pKR328 (described in PCT Publication No. WO 04/071467) comprising the *Saprolegnia diclina* delta-17 desaturase ["SdD17"] under control of the annexin promoter and having a hygromycin resistance gene for selection in plants, into soy embryo cultures as described in PCT Publication No. WO 2008/137516. After transformation, transgenic soy embryos are selected, matured, analyzed for fatty acid profiles and plants are regenerated.

In this way, embryos or seeds expressing the mutated delta-5 desaturases can be obtained which comprise long-chain PUFAs such as EPA and/or ARA.

Alternatively, the vectors, or fragments derived from them, co-expressing the mutated delta-5 desaturases along with the EgD9 and EgD8 genes can be co-transformed, with other vectors containing a suitable selectable marker, such as pKR325, described in U.S. Pat. No. 7,659,120. Embryos are matured and analyzed and plants regenerated in exactly the same way and thus alternate fatty acids profiles, such as increased ARA and reduced EPA, can be achieved in the seeds of the resulting plants.

Plasmids expressing the mutated delta-5 desaturases along with the EgD9 and EgD8 genes can be also co-transformed with vectors comprising genes or DNA fragments or artificial microRNAs designed to silence the endogenous soy fad3 genes, such as, but not limited to, pKR1189 or pKR1249 or other constructs previously described in U.S. Pat. Appl. Pub. No. 2008-0194685 A1. In this way, higher concentration of ARA and lower EPA in soy seeds can be achieved.

In addition to the genes, promoters, terminators and gene cassettes described herein, one skilled in the art can appreciate that other promoter/gene/terminator cassette combinations can be synthesized in a way similar to, but not limited to, that described herein for expression of delta-5 desaturase mutants. Similarly, it may be desirable to express other PUFA genes (such as those described below in Table 23), for co-expression with the delta-5 desaturase of the present invention.

For instance, PCT Publication Nos. WO 2004/071467 and WO 2004/071178 describe the isolation of a number of promoter and transcription terminator sequences for use in embryo-specific expression in soybean. Furthermore, PCT Publication Nos. WO 2004/071467, WO 2005/047479 and WO 2006/012325 describe the synthesis of multiple promoter/gene/terminator cassette combinations by ligating individual promoters, genes and transcription terminators together in unique combinations. Generally, a NotI site flanked by the suitable promoter (such as those listed in, but not limited to, Table 21) and a transcription terminator (such as those listed in, but not limited to, Table 22) is used to clone the desired gene. NotI sites can be added to a gene of interest such as those listed in, but not limited to, Table 23 using PCR amplification with oligonucleotides designed to introduce NotI sites at the 5' and 3' ends of the gene. The resulting PCR product is then digested with NotI and cloned into a suitable promoter/NotI/terminator cassette.

In addition, PCT Publication Nos. WO 2004/071467, WO 2005/047479 and WO 2006/012325 describe the further linking together of individual gene cassettes in unique combinations, along with suitable selectable marker cassettes, in order to obtain the desired phenotypic expression. Although this is done mainly using different restriction enzymes sites, one skilled in the art can appreciate that a number of techniques can be utilized to achieve the desired promoter/gene/transcription terminator combination. In so doing, any combination of embryo-specific promoter/gene/transcription terminator cassettes can be achieved. One skilled in the art can also appreciate that these cassettes can be located on individual DNA fragments or on multiple fragments where co-expression of genes is the outcome of co-transformation of multiple DNA fragments.

Furthermore, U.S. Pat. Appl. Pub. No. 2008-0254191-A1 describes the creation of a number of vectors that co-express individual delta-9 elongases with delta-8 desaturases, as well as the fusion of these genes to create multizymes. Any of the mutant delta-5 desaturases described herein can be co-expressed with the vectors described in U.S. Pat. Appl. Pub. No. 2008-0254191-A1, either by cloning into the described expression vectors or by co-transformation of suitable expression vectors as plasmid(s) or fragment(s) to achieve soy seeds that produce PUFAs such as, but not limited to, ARA, EPA, DPA and DHA.

TABLE 21

Seed-specific Promoters

| Promoter | Organism | Promoter Reference |
| --- | --- | --- |
| β-conglycinin α'-subunit | soybean | Beachy et al., *EMBO J.* 4: 3047-3053 (1985) |
| kunitz trypsin inhibitor | soybean | Jofuku et al., *Plant Cell* 1: 1079-1093(1989) |
| Annexin | soybean | WO 2004/071467 |
| glycinin Gy1 | soybean | WO 2004/071467 |
| albumin 2S | soybean | U.S. Pat. No. 6,177,613 |
| legumin A1 | pea | Rerie et al., *Mol. Gen. Genet.* 225: 148-157 (1991) |
| β-conglycinin β-subunit | soybean | WO 2004/071467 |
| BD30 (also called P34) | soybean | WO 2004/071467 |
| legumin A2 | pea | Rerie et al., *Mol. Gen. Genet.* 225: 148-157 (1991) |

TABLE 22

Transcription Terminators

| Transcription Terminator | Organism | Reference |
| --- | --- | --- |
| phaseolin 3' | bean | WO 2004/071467 |
| kunitz trypsin inhibitor 3' | soybean | WO 2004/071467 |
| BD30 (also called P34) 3' | soybean | WO 2004/071467 |
| legumin A2 3' | pea | WO 2004/071467 |
| albumin 2S 3' | soybean | WO 2004/071467 |

TABLE 23

PUFA Biosynthetic Pathway Genes

| Gene | Organism | Reference |
| --- | --- | --- |
| delta-6 desaturase | *Saprolegnia diclina* | WO 2002/081668 |
| delta-6 desaturase | *Mortierella alpina* | U.S. Pat. No. 5,968,809 |
| elongase | *Mortierella alpina* | WO 2000/12720<br>U.S. Pat. No. 6,403,349 |
| delta-5 desaturase | *Mortierella alpina* | U.S. Pat. No. 6,075,183 |
| delta-5 desaturase | *Saprolegnia diclina* | WO 2002/081668 |
| delta-5 desaturase | *Peridinium* sp. | U.S. Pat. No. 7,695,950 |
| delta-5 desaturase | *Euglena gracilis* | U.S. Pat. No. 7,678,560 |
| delta-15 desaturase | *Fusarium moniliforme* | U.S. Pat. No. 7,659,120 |
| delta-17 desaturase | *Saprolegnia diclina* | WO 2002/081668 |
| elongase | *Thraustochytrium aureum* | WO 2002/08401<br>U.S. Pat. No. 6,677,145 |
| elongase | *Pavlova* sp. | Pereira et al., *Biochem. J.* 384: 357-366 (2004) |
| delta-4 desaturase | *Schizochytrium aggregatum* | WO 2002/090493<br>U.S. Pat. No. 7,045,683 |
| delta-4 desaturase | *Isochrysis galbana* | WO 2002/090493<br>U.S. Pat. No. 7,045,683 |
| delta-4 desaturase | *Thraustochytrium aureum* | WO 2002/090493<br>U.S. Pat. No. 7,045,683 |
| delta-4 desaturase | *Euglena gracilis* | U.S. Pat. No. 7,629,503 |
| delta-9 elongase | *Isochrysis galbana* | WO 2002/077213 |
| delta-9 elongase | *Euglena gracilis* | U.S. Pat. No. 7,645,604 |
| delta-9 elongase | *Eutreptiella* sp. CCMP389 | U.S. Pat. No. 7,645,604 |
| delta-8 desaturase | *Euglena gracilis* | WO 2000/34439<br>U.S. Pat. No. 6,825,017<br>U.S. Pat. No. 7,709,239<br>WO 2004/057001<br>WO 2006/012325 |
| delta-8 desaturase | *Acanthamoeba castellanii* | Sayanova et al., *FEBS Lett.* 580: 1946-1952 (2006) |
| delta-8 desaturase | *Pavlova salina* | WO 2005/103253 |
| delta-8 desaturase | *Pavlova lutheri* | U.S. Pat. No. 7,943,823 |
| delta-8 desaturase | *Tetruetreptia pomquetensis* CCMP1491 | U.S. Pat. No. 7,863,502 |
| delta-8 desaturase | *Eutreptiella* sp. CCMP389 | U.S. Pat. No. 7,863,502 |
| delta-8 desaturase | *Eutreptiella cf_gymnastica* CCMP1594 | U.S. Pat. No. 7,863,502 |

SEQUENCE LISTING (311 sequences)

SEQ ID NO: 1 - protein, 5 aa, Artificial Sequence
  His-rich motif
  misc_feature (2)..(4): Xaa can be any naturally occurring amino acid
HXXXH

SEQ ID NO: 2 - protein, 6 aa, Artificial Sequence
  His-rich motif
  misc_feature (2)..(5): Xaa can be any naturally occurring amino acid
HXXXXH

SEQ ID NO: 3 - protein, 5 aa, Artificial Sequence
  His-rich motif
  misc_feature (2)..(3): Xaa can be any naturally occurring amino acid
HXXHH

SEQ ID NO: 4 - protein, 6 aa, Artificial Sequence
  His-rich motif
  misc_feature (2)..(4): Xaa can be any naturally occurring amino acid
HXXXHH

SEQ ID NO: 5 - protein, 5 aa, Artificial Sequence
  His-rich motif
  MISC_FEATURE (1)..(1): Xaa = Gln [Q] or His [H]
  misc_feature (2)..(3): Xaa can be any naturally occurring amino acid
XXXHH

SEQ ID NO: 6 - protein, 6 aa, Artificial Sequence
  His-rich motif
  MISC_FEATURE (1)..(1): Xaa = Gln [Q] or His [H]
  misc_feature (2)..(4): Xaa can be any naturally occurring amino acid
XXXXHH

SEQ ID NO: 7 - protein, 4 aa, Artificial Sequence
  HPGG motif
HPGG

SEQ ID NO: 8 - protein, 5 aa, Artificial Sequence
  HDASH motif
HDASH

SEQ ID NO: 9 - protein, 4 aa, Artificial Sequence
  HGGG motif
HGGG

SEQ ID NO: 10 - protein, 4 aa, Artificial Sequence
  HHGG motif
HHGG

SEQ ID NO: 11 - protein, 4 aa, Artificial Sequence
  HPGS motif
HPGS

SEQ ID NO: 12 - protein, 4 aa, Artificial Sequence
  HCGG motif
HCGG

SEQ ID NO: 13 - protein, 4 aa, Artificial Sequence
  HWGG motif
HWGG

SEQ ID NO: 14 - protein, 4 aa, Artificial Sequence
  HAGG motif
HAGG

SEQ ID NO: 15 - protein, 5 aa, Artificial Sequence
  HDGSH motif
HDGSH

SEQ ID NO: 16 - protein, 5 aa, Artificial Sequence
  HDSSH motif
HDSSH

SEQ ID NO: 17 - protein, 5 aa, Artificial Sequence
  HDAAH motif
HDAAH

SEQ ID NO: 18 - protein, 5 aa, Artificial Sequence
  HDAGH motif
HDAGH

SEQ ID NO: 19 - protein, 5 aa, Artificial Sequence
  HEASH motif
HEASH

SEQ ID NO: 20 - DNA, 1350 bp, Euglena gracilis
  CDS (1)..(1350): delta-5 desaturase
  ref <302>: TITLE: DELTA-5 DESATURASE AND ITS USE IN MAKING POLYUNSATURATED FATTY ACIDS
  ref <310>: PATENT DOCUMENT NUMBER: US 7,678,560
  ref <311>: PATENT FILING DATE: 2007-05-15
  ref <312>: PUBLICATION DATE: 2010-03-16
  ref <313>: RELEVANT RESIDUES IN SEQ ID NO: (1)..(1350)
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctga

SEQ ID NO: 21 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 22 - DNA, 1350 bp, Euglena gracilis
  CDS (1)..(1350): synthetic delta-5 desaturase (codon-optimized for Yarrowia lipolytica)
  ref <302>: TITLE: DELTA-5 DESATURASE AND ITS USE IN MAKING POLYUNSATURATED FATTY ACIDS
  ref <310>: PATENT DOCUMENT NUMBER: US 7,678,560
  ref <311>: PATENT FILING DATE: 2007-05-15
  ref <312>: PUBLICATION DATE: 2010-03-16
  ref <313>: RELEVANT RESIDUES IN SEQ ID NO: (1)..(1350)
atggctctctcccttactaccgagcagctgctcgagcgacccgacctggttgccatcgacggcattctctacgatctggaaggtcttgccaaggtccatcccggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 23 - protein, 449 aa, Euglena gracilis; identical to SEQ ID NO: 21

SEQ ID NO: 24 - DNA, 1350 bp, Euglena gracilis
  CDS (1)..(1350): delta-5 desaturase ("EgD5R")
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaa

SEQ ID NO: 25 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 26 - DNA, 1350 bp, Euglena gracilis
  CDS (1)..(1350): delta-5 desaturase ("EgD5R*")
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 27 - protein, 449 aa, Euglena gracilis; identical to SEQ ID NO: 25

SEQ ID NO: 28 - DNA, 1362 bp, Euglena anabaena UTEX 373
  CDS (1)..(1362): delta-5 desaturase
  ref <302>: TITLE: DELTA-5 DESATURASES AND THEIR USE IN MAKING POLYUNSATURATED FATTY ACIDS
  ref <310>: PATENT DOCUMENT NUMBER: US 7,943,365
  ref <311>: PATENT FILING DATE: 2008-04-29
  ref <312>: PUBLICATION DATE: 2011-05-17
  ref <313>: RELEVANT RESIDUES IN SEQ ID NO: (1)..(1362)
atggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattc

SEQ ID NO: 29 - protein, 454 aa, Euglena anabaena UTEX 373
MATISLTTEQLLEHPELVAIDGVLYDLFGLAKVHPGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 30 - DNA, 1362 bp, Euglena anabaena UTEX 373
  CDS (1)..(1362): synthetic delta-5 desaturase (codon-optimized for Yarrowia lipolytica)
  ref <302>: TITLE: DELTA-5 DESATURASES AND THEIR USE IN MAKING POLYUNSATURATED FATTY ACIDS
  ref <310>: PATENT DOCUMENT NUMBER: US 7,943,365
  ref <311>: PATENT FILING DATE: 2008-04-29
  ref <312>: PUBLICATION DATE: 2011-05-17
  ref <313>: RELEVANT RESIDUES IN SEQ ID NO: (1)..(1362)
atggccaccatctccctgactaccgagcagctcctggaacaccccgagctcgttgccatcgacggagtcctgtacgatctcttcggtctggccaaggtgcatccaggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttc

SEQ ID NO: 31 - protein, 454 aa, Euglena anabaena UTEX 373; identical to SEQ ID NO: 29

SEQ ID NO: 32 - protein, 4 aa, Artificial Sequence
  HXGG MOTIF
  misc_feature (2)..(2): Xaa can be any naturally occurring amino acid
HXGG

SEQ ID NO: 33 - protein, 4 aa, Artificial Sequence
  HPGX motif
  misc_feature (4)..(4): Xaa can be any naturally occurring amino acid
HPGX

SEQ ID NO: 34 - protein, 4 aa, Artificial Sequence
  HXGX motif
  misc_feature (2)..(2): Xaa can be any naturally occurring amino acid
  misc_feature (4)..(4): Xaa can be any naturally occurring amino acid
HXGX

SEQ ID NO: 35 - protein, 5 aa, Artificial Sequence
  HXASH motif
  misc_feature (2)..(2): Xaa can be any naturally occurring amino acid
HXASH

SEQ ID NO: 36 - protein, 5 aa, Artificial Sequence
  HDXSH motif
  misc_feature (3)..(3): Xaa can be any naturally occurring amino acid
HDXSH

SEQ ID NO: 37 - protein, 5 aa, Artificial Sequence
  HDAXH motif
  misc_feature (4)..(4): Xaa can be any naturally occurring amino acid
HDAXH

SEQ ID NO: 38 - DNA, 8438 bp, Artificial Sequence
  Plasmid pDMW367
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 39 - DNA, 8438 bp, Artificial Sequence
  Plasmid pDMW367-M4
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 40 - DNA, 31 bp, Artificial Sequence
  Primer YL 813
cgtcaaaccggagaactccaaattgcttcaa

SEQ ID NO: 41 - DNA, 31 bp, Artificial Sequence
  Primer YL 814
ttgaagcaatttggagttctccggtttgacg

SEQ ID NO: 42 - DNA, 31 bp, Artificial Sequence
  Primer YL 815
aactgcaaggttaagcgatctgagaaggacg

SEQ ID NO: 43 - DNA, 31 bp, Artificial Sequence
  Primer YL 816
cgtccttctcagatcgcttaaccttgcagtt

SEQ ID NO: 44 - DNA, 8438 bp, Artificial Sequence
  Plasmid pDMW367-M2
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 45 - DNA, 31 bp, Artificial Sequence
  Primer YL 829
gttccaccgcttccaggcttggtacatgtac

SEQ ID NO: 46 - DNA, 31 bp, Artificial Sequence
  Primer YL 830
gtacatgtaccaagcctggaagcggtggaac

SEQ ID NO: 47 - DNA, 32 bp, Artificial Sequence
  Primer YL 831
ggagtgttgcgaacgacatggagtgcgatatg

SEQ ID NO: 48 - DNA, 32 bp, Artificial Sequence
  Primer YL 832
catatcgcactccatgtcgttcgcaacactcc

SEQ ID NO: 49 - DNA, 39 bp, Artificial Sequence
  Primer
ttatccatccagcatgattgctcccacggggccatcagc

SEQ ID NO: 50 - DNA, 39 bp, Artificial Sequence
  Primer
gctgatggccccgtgggagcaatcatgctggatggataa

SEQ ID NO: 51 - DNA, 37 bp, Artificial Sequence
  Primer
tatccatccagcatgatgactcccacggggccatcag

SEQ ID NO: 52 - DNA, 37 bp, Artificial Sequence
  Primer
ctgatggccccgtgggagtcatcatgctggatggata

SEQ ID NO: 53 - DNA, 37 bp, Artificial Sequence
  Primer
tatccatccagcatgatgagtcccacggggccatcag

SEQ ID NO: 54 - DNA, 37 bp, Artificial Sequence
  Primer
ctgatggccccgtgggactcatcatgctggatggata

SEQ ID NO: 55 - DNA, 39 bp, Artificial Sequence
  Primer
ttatccatccagcatgatttctcccacggggccatcagc

SEQ ID NO: 56 - DNA, 39 bp, Artificial Sequence
  Primer
gctgatggccccgtgggagaaatcatgctggatggataa

SEQ ID NO: 57 - DNA, 39 bp, Artificial Sequence
  Primer
ttatccatccagcatgatggctcccacggggccatcagc

SEQ ID NO: 58 - DNA, 39 bp, Artificial Sequence
  Primer
gctgatggccccgtgggagccatcatgctggatggataa

SEQ ID NO: 59 - DNA, 37 bp, Artificial Sequence
  Primer
tatccatccagcatgatcactcccacggggccatcag

SEQ ID NO: 60 - DNA, 37 bp, Artificial Sequence
  Primer
ctgatggccccgtgggagtgatcatgctggatggata

SEQ ID NO: 61 - DNA, 37 bp, Artificial Sequence
  Primer
tatccatccagcatgatatctcccacggggccatcag

SEQ ID NO: 62 - DNA, 37 bp, Artificial Sequence
  Primer
ctgatggccccgtgggagatatcatgctggatggata

SEQ ID NO: 63 - DNA, 37 bp, Artificial Sequence
  Primer
tatccatccagcatgataagtcccacggggccatcag

SEQ ID NO: 64 - DNA, 37 bp, Artificial Sequence
  Primer
ctgatggccccgtgggacttatcatgctggatggata

SEQ ID NO: 65 - DNA, 37 bp, Artificial Sequence
  Primer
tatccatccagcatgatctgtcccacggggccatcag

SEQ ID NO: 66 - DNA, 37 bp, Artificial Sequence
  Primer
ctgatggccccgtgggacagatcatgctggatggata

SEQ ID NO: 67 - DNA, 37 bp, Artificial Sequence
  Primer
tatccatccagcatgatatgtcccacggggccatcag

SEQ ID NO: 68 - DNA, 37 bp, Artificial Sequence
  Primer
ctgatggccccgtgggacatatcatgctggatggata

SEQ ID NO: 69 - DNA, 37 bp, Artificial Sequence
  Primer
tatccatccagcatgataactcccacggggccatcag

SEQ ID NO: 70 - DNA, 37 bp, Artificial Sequence
  Primer
ctgatggccccgtgggagttatcatgctggatggata

SEQ ID NO: 71 - DNA, 37 bp, Artificial Sequence
  Primer
tatccatccagcatgatccctcccacggggccatcag

SEQ ID NO: 72 - DNA, 37 bp, Artificial Sequence
  Primer
ctgatggccccgtgggagggatcatgctggatggata

SEQ ID NO: 73 - DNA, 37 bp, Artificial Sequence
  Primer
tatccatccagcatgatcaatcccacggggccatcag

SEQ ID NO: 74 - DNA, 37 bp, Artificial Sequence
  Primer
ctgatggccccgtgggattgatcatgctggatggata

SEQ ID NO: 75 - DNA, 37 bp, Artificial Sequence
  Primer
tatccatccagcatgatcgatcccacggggccatcag

SEQ ID NO: 76 - DNA, 37 bp, Artificial Sequence
  Primer
ctgatggccccgtgggatcgatcatgctggatggata

SEQ ID NO: 77 - DNA, 39 bp, Artificial Sequence
  Primer
ttatccatccagcatgattcctcccacggggccatcagc

SEQ ID NO: 78 - DNA, 39 bp, Artificial Sequence
  Primer
gctgatggccccgtgggaggaatcatgctggatggataa

SEQ ID NO: 79 - DNA, 37 bp, Artificial Sequence
  Primer
tatccatccagcatgatacctcccacggggccatcag

SEQ ID NO: 80 - DNA, 37 bp, Artificial Sequence
  Primer
ctgatggccccgtgggaggtatcatgctggatggata

SEQ ID NO: 81 - DNA, 37 bp, Artificial Sequence
  Primer
tatccatccagcatgatgtctcccacggggccatcag

SEQ ID NO: 82 - DNA, 37 bp, Artificial Sequence
  Primer
ctgatggccccgtgggagacatcatgctggatggata

SEQ ID NO: 83 - DNA, 37 bp, Artificial Sequence
  Primer
tatccatccagcatgattggtcccacggggccatcag

SEQ ID NO: 84 - DNA, 37 bp, Artificial Sequence
  Primer
ctgatggccccgtgggaccaatcatgctggatggata

SEQ ID NO: 85 - DNA, 39 bp, Artificial Sequence
  Primer
ttatccatccagcatgattactcccacggggccatcagc

SEQ ID NO: 86 - DNA, 39 bp, Artificial Sequence
  Primer
gctgatggccccgtgggagtaatcatgctggatggataa

SEQ ID NO: 87 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDGSHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 88 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDSSHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 89 - DNA, 39 bp, Artificial Sequence
  Primer
tccatccagcatgatgcggctcacggggccatcagcaag

SEQ ID NO: 90 - DNA, 39 bp, Artificial Sequence
  Primer
cttgctgatggccccgtgagccgcatcatgctggatgga

SEQ ID NO: 91 - DNA, 39 bp, Artificial Sequence
  Primer
tccatccagcatgatgcgtgccacggggccatcagcaag

SEQ ID NO: 92 - DNA, 39 bp, Artificial Sequence
  Primer
cttgctgatggccccgtggcacgcatcatgctggatgga

SEQ ID NO: 93 - DNA, 39 bp, Artificial Sequence
  Primer
tccatccagcatgatgcggaccacggggccatcagcaag

SEQ ID NO: 94 - DNA, 39 bp, Artificial Sequence
  Primer
cttgctgatggccccgtggtccgcatcatgctggatgga

SEQ ID NO: 95 - DNA, 39 bp, Artificial Sequence
  Primer
tccatccagcatgatgcggagcacggggccatcagcaag

SEQ ID NO: 96 - DNA, 39 bp, Artificial Sequence
  Primer
cttgctgatggccccgtgctccgcatcatgctggatgga

SEQ ID NO: 97 - DNA, 39 bp, Artificial Sequence
  Primer
tccatccagcatgatgcgttccacggggccatcagcaag

SEQ ID NO: 98 - DNA, 39 bp, Artificial Sequence
  Primer
cttgctgatggccccgtggaacgcatcatgctggatgga

SEQ ID NO: 99 - DNA, 39 bp, Artificial Sequence
  Primer
tccatccagcatgatgcgggtcacggggccatcagcaag

SEQ ID NO: 100 - DNA, 39 bp, Artificial Sequence
  Primer
cttgctgatggccccgtgacccgcatcatgctggatgga

SEQ ID NO: 101 - DNA, 39 bp, Artificial Sequence
  Primer
tccatccagcatgatgcgcaccacggggccatcagcaag

SEQ ID NO: 102 - DNA, 39 bp, Artificial Sequence
  Primer
cttgctgatggccccgtggtgcgcatcatgctggatgga

SEQ ID NO: 103 - DNA, 39 bp, Artificial Sequence
  Primer
tccatccagcatgatgcgatccacggggccatcagcaag

SEQ ID NO: 104 - DNA, 39 bp, Artificial Sequence
  Primer
cttgctgatggccccgtggatcgcatcatgctggatgga

SEQ ID NO: 105 - DNA, 39 bp, Artificial Sequence
  Primer
tccatccagcatgatgcgaagcacggggccatcagcaag

SEQ ID NO: 106 - DNA, 39 bp, Artificial Sequence
  Primer
cttgctgatggccccgtgcttcgcatcatgctggatgga

SEQ ID NO: 107 - DNA, 39 bp, Artificial Sequence
  Primer
tccatccagcatgatgcgctgcacggggccatcagcaag

SEQ ID NO: 108 - DNA, 39 bp, Artificial Sequence
  Primer
cttgctgatggccccgtgcagcgcatcatgctggatgga

SEQ ID NO: 109 - DNA, 39 bp, Artificial Sequence
  Primer
tccatccagcatgatgcgatgcacggggccatcagcaag

SEQ ID NO: 110 - DNA, 39 bp, Artificial Sequence
  Primer
cttgctgatggccccgtgcatcgcatcatgctggatgga

SEQ ID NO: 111 - DNA, 39 bp, Artificial Sequence
  Primer
tccatccagcatgatgcgaaccacggggccatcagcaag

SEQ ID NO: 112 - DNA, 39 bp, Artificial Sequence
  Primer
cttgctgatggccccgtggttcgcatcatgctggatgga

SEQ ID NO: 113 - DNA, 39 bp, Artificial Sequence
  Primer
tccatccagcatgatgcgcctcacggggccatcagcaag

SEQ ID NO: 114 - DNA, 39 bp, Artificial Sequence
  Primer
cttgctgatggccccgtgaggcgcatcatgctggatgga

SEQ ID NO: 115 - DNA, 39 bp, Artificial Sequence
  Primer
tccatccagcatgatgcgcagcacggggccatcagcaag

SEQ ID NO: 116 - DNA, 39 bp, Artificial Sequence
  Primer
cttgctgatggccccgtgctgcgcatcatgctggatgga

SEQ ID NO: 117 - DNA, 39 bp, Artificial Sequence
  Primer
tccatccagcatgatgcgcgacacggggccatcagcaag

SEQ ID NO: 118 - DNA, 39 bp, Artificial Sequence
  Primer
cttgctgatggccccgtgtcgcgcatcatgctggatgga

SEQ ID NO: 119 - DNA, 39 bp, Artificial Sequence
  Primer
tccatccagcatgatgcgacccacggggccatcagcaag

SEQ ID NO: 120 - DNA, 39 bp, Artificial Sequence
  Primer
cttgctgatggccccgtgggtcgcatcatgctggatgga

SEQ ID NO: 121 - DNA, 39 bp, Artificial Sequence
  Primer
tccatccagcatgatgcggtccacggggccatcagcaag

SEQ ID NO: 122 - DNA, 39 bp, Artificial Sequence
  Primer
cttgctgatggccccgtggaccgcatcatgctggatgga

SEQ ID NO: 123 - DNA, 39 bp, Artificial Sequence
  Primer
tccatccagcatgatgcgtggcacggggccatcagcaag

SEQ ID NO: 124 - DNA, 39 bp, Artificial Sequence
  Primer
cttgctgatggccccgtgccacgcatcatgctggatgga

SEQ ID NO: 125 - DNA, 39 bp, Artificial Sequence
  Primer
tccatccagcatgatgcgtaccacggggccatcagcaag

SEQ ID NO: 126 - DNA, 39 bp, Artificial Sequence
  Primer
cttgctgatggccccgtggtacgcatcatgctggatgga

SEQ ID NO: 127 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAAHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 128 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 129 - DNA, 8438 bp, Artificial Sequence
  Plasmid pDMW367M4-157g
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatggctcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 130 - DNA, 8438 bp, Artificial Sequence
  Plasmid pDMW367M4-158a
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcggctcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 131 - DNA, 8438 bp, Artificial Sequence
  Plasmid pDMW367M4-158g
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 132 - DNA, 38 bp, Artificial Sequence
  Primer
ggcttgccaaagttcatggcggaggagatttgattctc

SEQ ID NO: 133 - DNA, 38 bp, Artificial Sequence
  Primer
gagaatcaaatctcctccgccatgaactttggcaagcc

SEQ ID NO: 134 - DNA, 38 bp, Artificial Sequence
  Primer
ggcttgccaaagttcatcacggaggagatttgattctc

SEQ ID NO: 135 - DNA, 38 bp, Artificial Sequence
  Primer
gagaatcaaatctcctccgtgatgaactttggcaagcc

SEQ ID NO: 136 - DNA, 38 bp, Artificial Sequence
  Primer
ccaaagttcatccaggatccgatttgattctcgcttct

SEQ ID NO: 137 - DNA, 38 bp, Artificial Sequence
  Primer
agaagcgagaatcaaatcggatcctggatgaactttgg

SEQ ID NO: 138 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatggtggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatggctcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 139 - protein, 449 aa, Euglena gracilis
MALSLTTEQLLERPDLVAIDGILYDLEGLAKVHGGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDGSHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 140 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatggtggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcggctcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 141 - protein, 449 aa, Euglena gracilis
MALSLTTEQLLERPDLVAIDGILYDLEGLAKVHGGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAAHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 142 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatggtggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 143 - protein, 449 aa, Euglena gracilis
MALSLTTEQLLERPDLVAIDGILYDLEGLAKVHGGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 144 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatcacggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcggctcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 145 - protein, 449 aa, Euglena gracilis
MALSLTTEQLLERPDLVAIDGILYDLEGLAKVHHGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAAHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 146 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatcacggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 147 - protein, 449 aa, Euglena gracilis
MALSLTTEQLLERPDLVAIDGILYDLEGLAKVHHGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 148 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatccaggatccgatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcggctcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 149 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAAHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 150 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatccaggatccgatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 151 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 152 - DNA, 1350 bp, Euglena gracilis
  CDS (1)..(1350): EgD5M (i.e., EgD5R*-34g158g) mutant delta-5 desaturase
atggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 153 - protein, 449 aa, Euglena gracilis; identical to SEQ ID NO: 143

SEQ ID NO: 154 - DNA, 4070 bp, Artificial Sequence
  Plasmid pEgD5M
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccatggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaattcgagctcggtacctcgcgaatgcatctagatatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 155 - DNA, 8438 bp, Artificial Sequence
  Plasmid pDMW367-5M
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagc

SEQ ID NO: 156 - DNA, 1350 bp, Euglena gracilis
  CDS (1)..(1350): EgD5M1 (i.e., EgD5R*-34g158g347s) mutant delta-5 desaturase
atggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 157 - protein, 449 aa, Euglena gracilis
MALSLTTEQLLERPDLVAIDGILYDLEGLAKVHGGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 158 - DNA, 4070 bp, Artificial Sequence
  Plasmid pEgD5M1
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccatggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaattcgagctcggtacctcgcgaatgcatctagatatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 159 - DNA, 8438 bp, Artificial Sequence
  Plasmid pDMW367-5M1
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagc

SEQ ID NO: 160 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 161 - DNA, 8438 bp, Artificial Sequence
  Plasmid pDMW369S
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagc

SEQ ID NO: 162 - DNA, 39 bp, Artificial Sequence
  Primer
cctgtccattcagcacgatttctctcatggtgccatcag

SEQ ID NO: 163 - DNA, 39 bp, Artificial Sequence
  Primer
ctgatggcaccatgagagaaatcgtgctgaatggacagg

SEQ ID NO: 164 - DNA, 39 bp, Artificial Sequence
  Primer
cctgtccattcagcacgatatgtctcatggtgccatcag

SEQ ID NO: 165 - DNA, 39 bp, Artificial Sequence
  Primer
ctgatggcaccatgagacatatcgtgctgaatggacagg

SEQ ID NO: 166 - DNA, 36 bp, Artificial Sequence
  Primer
gtccattcagcacgatggttctcatggtgccatcag

SEQ ID NO: 167 - DNA, 36 bp, Artificial Sequence
  Primer
ctgatggcaccatgagaaccatcgtgctgaatggac

SEQ ID NO: 168 - DNA, 31 bp, Artificial Sequence
  Primer
gtccattcagcacgattcctctcatggtgcc

SEQ ID NO: 169 - DNA, 31 bp, Artificial Sequence
  Primer
ggcaccatgagaggaatcgtgctgaatggac

SEQ ID NO: 170 - DNA, 33 bp, Artificial Sequence
  Primer
cattcagcacgatgccgctcatggtgccatcag

SEQ ID NO: 171 - DNA, 33 bp, Artificial Sequence
  Primer
ctgatggcaccatgagcggcatcgtgctgaatg

SEQ ID NO: 172 - DNA, 45 bp, Artificial Sequence
  Primer
ctgtccattcagcacgatgccaaccatggtgccatcagcaaaaag

SEQ ID NO: 173 - DNA, 45 bp, Artificial Sequence
  Primer
ctttttgctgatggcaccatggttggcatcgtgctgaatggacag

SEQ ID NO: 174 - DNA, 35 bp, Artificial Sequence
  Primer
cattcagcacgatgccacccatggtgccatcagca

SEQ ID NO: 175 - DNA, 35 bp, Artificial Sequence
  Primer
tgctgatggcaccatgggtggcatcgtgctgaatg

SEQ ID NO: 176 - DNA, 34 bp, Artificial Sequence
  Primer
cattcagcacgatgccggtcatggtgccatcagc

SEQ ID NO: 177 - DNA, 34 bp, Artificial Sequence
  Primer
gctgatggcaccatgaccggcatcgtgctgaatg

SEQ ID NO: 178 - DNA, 31 bp, Artificial Sequence
  Primer
ctgtccattcagcacgaggcctctcatggtg

SEQ ID NO: 179 - DNA, 31 bp, Artificial Sequence
  Primer
caccatgagaggcctcgtgctgaatggacag

SEQ ID NO: 180 - DNA, 1350 bp, Euglena gracilis
  CDS (1)..(1350)
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgaggcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 181 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHEASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 182 - DNA, 1350 bp, Euglena gracilis
  CDS (1)..(1350): EgD5S-36s157g mutant delta-5 desaturase
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatggttctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 183 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDGSHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 184 - DNA, 1350 bp, Euglena gracilis
  CDS (1)..(1350)
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgccgctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 185 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAAHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 186 - DNA, 1350 bp, Euglena gracilis
  CDS (1)..(1350)
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgccggtcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 187 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 188 - protein, 454 aa, Euglena anabaena
MATISLTTEQLLEHPELVAIDGVLYDLFGLAKVHAGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 189 - DNA, 8357 bp, Artificial Sequence
  Plasmid pZuFmEaD5S-A(S)
catggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 190 - DNA, 32 bp, Artificial Sequence
  Primer
ttggccattcaacacgaggcttctcacggagc

SEQ ID NO: 191 - DNA, 32 bp, Artificial Sequence
  Primer
gctccgtgagaagcctcgtgttgaatggccaa

SEQ ID NO: 192 - DNA, 44 bp, Artificial Sequence
  Primer
gattggcttggccattcaacacgatttctctcacggagccatca

SEQ ID NO: 193 - DNA, 44 bp, Artificial Sequence
  Primer
tgatggctccgtgagagaaatcgtgttgaatggccaagccaatc

SEQ ID NO: 194 - DNA, 33 bp, Artificial Sequence
  Primer
gccattcaacacgatggttctcacggagccatc

SEQ ID NO: 195 - DNA, 33 bp, Artificial Sequence
  Primer
gatggctccgtgagaaccatcgtgttgaatggc

SEQ ID NO: 196 - DNA, 44 bp, Artificial Sequence
  Primer
gattggcttggccattcaacacgatatgtctcacggagccatca

SEQ ID NO: 197 - DNA, 44 bp, Artificial Sequence
  Primer
tgatggctccgtgagacatatcgtgttgaatggccaagccaatc

SEQ ID NO: 198 - DNA, 37 bp, Artificial Sequence
  Primer
ggcttggccattcaacacgattcctctcacggagcca

SEQ ID NO: 199 - DNA, 37 bp, Artificial Sequence
  Primer
tggctccgtgagaggaatcgtgttgaatggccaagcc

SEQ ID NO: 200 - DNA, 44 bp, Artificial Sequence
  Primer
gattggcttggccattcaacacgattactctcacggagccatca

SEQ ID NO: 201 - DNA, 44 bp, Artificial Sequence
  Primer
tgatggctccgtgagagtaatcgtgttgaatggccaagccaatc

SEQ ID NO: 202 - DNA, 37 bp, Artificial Sequence
  Primer
ccattcaacacgatgctgcccacggagccatcagcaa

SEQ ID NO: 203 - DNA, 37 bp, Artificial Sequence
  Primer
ttgctgatggctccgtgggcagcatcgtgttgaatgg

SEQ ID NO: 204 - DNA, 32 bp, Artificial Sequence
  Primer
ggccattcaacacgatgcttgtcacggagcca

SEQ ID NO: 205 - DNA, 32 bp, Artificial Sequence
  Primer
tggctccgtgacaagcatcgtgttgaatggcc

SEQ ID NO: 206 - DNA, 36 bp, Artificial Sequence
  Primer
cttggccattcaacacgatgctggtcacggagccat

SEQ ID NO: 207 - DNA, 36 bp, Artificial Sequence
  Primer
atggctccgtgaccagcatcgtgttgaatggccaag

SEQ ID NO: 208 - DNA, 45 bp, Artificial Sequence
  Primer
ttggccattcaacacgatgctaaccacggagccatcagcaaaaag

SEQ ID NO: 209 - DNA, 45 bp, Artificial Sequence
  Primer
ctttttgctgatggctccgtggttagcatcgtgttgaatggccaa

SEQ ID NO: 210 - DNA, 37 bp, Artificial Sequence
  Primer
ccattcaacacgatgctacccacggagccatcagcaa

SEQ ID NO: 211 - DNA, 37 bp, Artificial Sequence
  Primer
ttgctgatggctccgtgggtagcatcgtgttgaatgg

SEQ ID NO: 212 - DNA, 1365 bp, Euglena anabaena
  CDS (1)..(1365): EaD5S-35a158g mutant delta-5 desaturase
atggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatggttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaa

SEQ ID NO: 213 - protein, 454 aa, Euglena anabaena
MATISLTTEQLLEHPELVAIDGVLYDLFGLAKVHAGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDGSHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 214 - DNA, 1365 bp, Euglena anabaena
  CDS (1)..(1365)
atggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgattcctctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaa

SEQ ID NO: 215 - protein, 454 aa, Euglena anabaena
MATISLTTEQLLEHPELVAIDGVLYDLFGLAKVHAGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDSSHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 216 - DNA, 1365 bp, Euglena anabaena
  CDS (1)..(1365)
atggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgctggtcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaa

SEQ ID NO: 217 - protein, 454 aa, Euglena anabaena
MATISLTTEQLLEHPELVAIDGVLYDLFGLAKVHAGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDAGHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 218 - DNA, 4313 bp, Artificial Sequence
  Plasmid pZKUM
taatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaat

SEQ ID NO: 219 - DNA, 13565 bp, Artificial Sequence
  Plasmid pZKL3-9DPN9N
gtacggattgtgtatgtccctgtacctgcatcttgatggagagagctccggaaagcggatcaggagctgtccaattttaattttataacatggaaacgagtccttggagctagaagaccattttttcaactgccctatcgactatatttatctactccaaaaccgactgcttcccaagaatcttcagccaaggcttccaaagtaacccctcgcttcccgacacttaattgaaaccttagatgcagtcactgcgagtgaagtggactctaacatctccaacatagcgacgatattgcgagggtttgaatataactaagatgcatgatccattacatttgtagaaatatcataaacaacgaagcacatagacagaatgctgttggttgttacatctgaagccgaggtaccgatgtcattttcagctgtcactgcagagacaggggtatgtcacatttgaagatcatacaaccgacgtttatgaaaaccagagatatagagaatgtattgacggttgtggctatgtcataagtgcagtgaagtgcagtgattataggtatagtacacttactgtagctacaagtacatactgctacagtaatactcatgtatgcaaaccgtattctgtgtctacagaaggcgatacggaagagtcaatctcttatgtagagccatttctataatcgaaggggccttgtaatttccaaacgagtaattgagtaattgaagagcatcgtagacattacttatcatgtattgtgagagggaggagatgcagctgtagctactgcacatactgtactcgcccatgcagggataatgcatagcgagacttggcagtaggtgacagttgctagctgctacttgtagtcgggtgggtgatagcatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcaggaatagacatcttcaataggagcattaatacctgtgggatcactgatgtaaacttctcccagagtatgtgaataaccagcgggccatccaacaaagaagtcgttccagtgagtgactcggtacatccgtctttcggggttgatggtaagtccgtcgtctccttgcttaaagaacagagcgtccacgtagtctgcaaaagccttgtttccaagtcgaggctgcccatagttgattagcgttggatcatatccaagattcttcaggttgatgcccatgaatagagcagtgacagctcctagagagtggccagttacgatcaatttgtagtcagtgttgtttccaaggaagtcgaccagacgatcctgtacgttcaccatagtctctctgtatgccttctgaaagccatcatgaacttggcagccaggacaattgatactggcagaagggtttgtggagtttatgtcagtagtgttaagaggagggatactggtcatgtagggttgttggatcgtttggatgtcagtaatagcgtctgcaatggagaaagtgcctcggaaaacaatatacttttcctttttggtgtgatcgtgggccaaaaatccagtaactgaagtcgagaagaaatttcctccaaactggtagtcaagagtcacatcgggaaaatgagcgcaagagtttccacaggtaaaatcgctctgcagggcaaatgggccaggggctctgacacaataggccacgttagatagccatccgtacttgagaacaaagtcgtatgtctcctgggtgataggagccgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggccaaaagcaaacgacggtcggaggctgtggaagagcacgtgaccggctcggacgagggcttgaccgatacttcgggtcacgtgagccctgccgccaagaagcagaagaactcggagattcatttcaccacccaggctgcccagcagttggatcgggagcgcaaggaggagtatctggactcgctgatcgacaacaaggactatctcaagtaccgtcctcgaggctggaagctcaacaacccgcctaccgaccgacctgtgcgaatctacgccgatggagtgtttgatttgttccatctgggacacatgcgtcagctggagcagtccaagaaggccttccccaacgcagtgttgattgtgggcattcccagcgacaaggagacccacaagcggaagggattgaccgtgctgagtgacgtccagcggtacgagacggtgcgacactgcaagtgggtggacgaggtggtggaggatgctccctggtgtgtcaccatggactttctggaaaaacacaaaatcgactacgtggcccatgacgatctgccctacgcttccggcaacgacgatgatatctacaagcccatcaaggagaagggcatgtttctggccacccagcgaaccgagggcatttccacctcggacatcatcaccaagattatccgagactacgacaagtatttaatgcgaaactttgcccggggtgctaaccgaaaggatctcaacgtctcgtggctcaagaagaacgagctggacttcaagcgtcatgtggccgagttccgaaactcgttcaagcgaaagaaggtcggtaaggatctctacggcgagattcgcggtctgctgcagaatgtgctcatttggaacggcgacaactccggcacttccactccccagcgaaagacgctgcagaccaacgccaagaagatgtacatgaacgtgctcaagactctgcaggctcctgacgctgttgacgtggactcctcggagaacgtgtctgagaacgtcactgatgaggaggaggaagacgacgacgaggttgatgaggacgaagaagccgacgacgacgacgaagacgacgaagacgaggaagacgacgagtaggcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacacgcagtaggatgtcctgcacgggtctttttgtggggtgtggagaaaggggtgcttggagatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaacatggccatcaaagtcggtattaacggattcgggcgaatcggacgaattgtgagtaccatagaaggtgatggaaacatgacccaacagaaacagatgacaagtgtcatcgacccaccagagcccaattgagctcatactaacagtcgacaacctgtcgaaccaattgatgactccccgacaatgtactaacacaggtcctgcccatggtgaaaaacgtggaccaagtggatctctcgcaggtcgacaccattgcctccggccgagatgtcaactacaaggtcaagtacacctccggcgttaagatgagccagggcgcctacgacgacaagggccgccacatttccgagcagcccttcacctgggccaactggcaccagcacatcaactggctcaacttcattctggtgattgcgctgcctctgtcgtcctttgctgccgctcccttcgtctccttcaactggaagaccgccgcgtttgctgtcggctattacatgtgcaccggtctcggtatcaccgccggctaccaccgaatgtgggcccatcgagcctacaaggccgctctgcccgttcgaatcatccttgctctgtttggaggaggagctgtcgagggctccatccgatggtgggcctcgtctcaccgagtccaccaccgatggaccgactccaacaaggacccttacgacgcccgaaagggattctggttctcccactttggctggatgctgcttgtgcccaaccccaagaacaagggccgaactgacatttctgacctcaacaacgactgggttgtccgactccagcacaagtactacgtttacgttctcgtcttcatggccattgttctgcccaccctcgtctgtggctttggctggggcgactggaagggaggtcttgtctacgccggtatcatgcgatacacctttgtgcagcaggtgactttctgtgtcaactcccttgcccactggattggagagcagcccttcgacgaccgacgaactccccgagaccacgctcttaccgccctggtcacctttggagagggctaccacaacttccaccacgagttcccctcggactaccgaaacgccctcatctggtaccagtacgaccccaccaagtggctcatctggaccctcaagcaggttggtctcgcctgggacctccagaccttctcccagaacgccatcgagcagggtctcgtgcagcagcgacagaagaagctggacaagtggcgaaacaacctcaactggggtatccccattgagcagctgcctgtcattgagtttgaggagttccaagagcaggccaagacccgagatctggttctcatttctggcattgtccacgacgtgtctgcctttgtcgagcaccaccctggtggaaaggccctcattatgagcgccgtcggcaaggacggtaccgctgtcttcaacggaggtgtctaccgacactccaacgctggccacaacctgcttgccaccatgcgagtttcggtcattcgaggcggcatggaggttgaggtgtggaagactgcccagaacgaaaagaaggaccagaacattgtctccgatgagagtggaaaccgaatccaccgagctggtctccaggccacccgggtcgagaaccccggtatgtctggcatggctgcttaggcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgc

SEQ ID NO: 220 - DNA, 777 bp, Euglena gracilis
  CDS (1)..(777): mutant delta-9 elongase "EgD9eS-L35G"
atggaggtcgtgaacgaaatcgtctccattggccaggaggttcttcccaaggtcgactatgctcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 221 - protein, 258 aa, Euglena gracilis
MEVVNEIVSIGQEVLPKVDYAQLWSDASHCEVLYGSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 222 - DNA, 1449 bp, Yarrowia lipolytica
  CDS (1)..(1449): delta-9 desaturase; GenBank Accession No. XM_501496
atggtgaaaaacgtggaccaagtggatctctcgcaggtcgacaccattgcctccggccgagatgtcaactacaaggtcaagtacacctccggcgttaagatgagccagggcgcctacgacgacaagggccgccacatttccgagcagcccttcacctgggccaactggcaccagcacatcaactggctcaacttcattctggtgattgcgctgcctctgtcgtcctttgctgccgctcccttcgtctccttcaactggaagaccgccgcgtttgctgtcggctattacatgtgcaccggtctcggtatcaccgccggctaccaccgaatgtgggcccatcgagcctacaaggccgctctgcccgttcgaatcatccttgctctgtttggaggaggagctgtcgagggctccatccgatggtgggcctcgtctcaccgagtccaccaccgatggaccgactccaacaaggacccttacgacgcccgaaagggattctggttctcccactttggctggatgctgcttgtgcccaaccccaagaacaagggccgaactgacatttctgacctcaacaacgactgggttgtccgactccagcacaagtactacgtttacgttctcgtcttcatggccattgttctgcccaccctcgtctgtggctttggctggggcgactggaagggaggtcttgtctacgccggtatcatgcgatacacctttgtgcagcaggtgactttctgtgtcaactcccttgcccactggattggagagcagcccttcgacgaccgacgaactccccgagaccacgctcttaccgccctggtcacctttggagagggctaccacaacttccaccacgagttcccctcggactaccgaaacgccctcatctggtaccagtacgaccccaccaagtggctcatctggaccctcaagcaggttggtctcgcctgggacctccagaccttctcccagaacgccatcgagcagggtctcgtgcagcagcgacagaagaagctggacaagtggcgaaacaacctcaactggggtatccccattgagcagctgcctgtcattgagtttgaggagttccaagagcaggccaagacccgagatctggttctcatttctggcattgtccacgacgtgtctgcctttgtcgagcaccaccctggtggaaaggccctcattatgagcgccgtcggcaaggacggtaccgctgtcttcaacggaggtgtctaccgacactccaacgctggccacaacctgcttgccaccatgcgagtttcggtcattcgaggcggcatggaggttgaggtgtggaagactgcccagaacgaaaagaaggaccagaacattgtctccgatgagagtggaaaccgaatccaccgagctggtctccaggccacccgggtcgagaaccccggtatgtctggcatggctgcttag

SEQ ID NO: 223 - protein, 482 aa, Yarrowia lipolytica
MVKNVDQVDLSQVDTIASGRDVNYKVKYTSGVKMSQGAYDDKGRHISEQPFTWANWHQHINWLNFILVIALPLSSFAAAPFVSFNWKTAAFAVGYYMCTGLGITAGYHRMWAHRAYKAALPVRIILALFGGGAVEGSIRWWASSHRVHHRWTDSNKDPYDARKGFWFSHFGWMLLVPNPKNKGRTDISDLNNDWVVRLQHKYYVYVLVFMAIVLPTLVCGFGWGDWKGGLVYAGIMRYTFVQQVTFCVNSLAHWIGEQPFDDRRTPRDHALTALVTFGEGYHNFHHEFPSDYRNALIWYQYDPTKWLIWTLKQVGLAWDLQTFSQNAIEQGLVQQRQKKLDKWRNNLNWGIPIEQLPVIEFEEFQEQAKTRDLVLISGIVHDVSAFVEHHPGGKALIMSAVGKDGTAVFNGGVYRHSNAGHNLLATMRVSVIRGGMEVEVWKTAQNEKKDQNIVSDESGNRIHRAGLQATRVENPGMSGMAA

SEQ ID NO: 224 - DNA, 1101 bp, Yarrowia lipolytica
  CDS (1)..(1101): cholinephosphate cytidylyltransferase; GenBank Accession No. XM_502978
atggccaaaagcaaacgacggtcggaggctgtggaagagcacgtgaccggctcggacgagggcttgaccgatacttcgggtcacgtgagccctgccgccaagaagcagaagaactcggagattcatttcaccacccaggctgcccagcagttggatcgggagcgcaaggaggagtatctggactcgctgatcgacaacaaggactatctcaagtaccgtcctcgaggctggaagctcaacaacccgcctaccgaccgacctgtgcgaatctacgccgatggagtgtttgatttgttccatctgggacacatgcgtcagctggagcagtccaagaaggccttccccaacgcagtgttgattgtgggcattcccagcgacaaggagacccacaagcggaagggattgaccgtgctgagtgacgtccagcggtacgagacggtgcgacactgcaagtgggtggacgaggtggtggaggatgctccctggtgtgtcaccatggactttctggaaaaacacaaaatcgactacgtggcccatgacgatctgccctacgcttccggcaacgacgatgatatctacaagcccatcaaggagaagggcatgtttctggccacccagcgaaccgagggcatttccacctcggacatcatcaccaagattatccgagactacgacaagtatttaatgcgaaactttgcccggggtgctaaccgaaaggatctcaacgtctcgtggctcaagaagaacgagctggacttcaagcgtcatgtggccgagttccgaaactcgttcaagcgaaagaaggtcggtaaggatctctacggcgagattcgcggtctgctgcagaatgtgctcatttggaacggcgacaactccggcacttccactccccagcgaaagacgctgcagaccaacgccaagaagatgtacatgaacgtgctcaagactctgcaggctcctgacgctgttgacgtggactcctcggagaacgtgtctgagaacgtcactgatgaggaggaggaagacgacgacgaggttgatgaggacgaagaagccgacgacgacgacgaagacgacgaagacgaggaagacgacgagtag

SEQ ID NO: 225 - protein, 366 aa, Yarrowia lipolytica
MAKSKRRSEAVEEHVTGSDEGLTDTSGHVSPAAKKQKNSEIHFTTQAAQQLDRERKEEYLDSLIDNKDYLKYRPRGWKLNNPPTDRPVRIYADGVFDLFHLGHMRQLEQSKKAFPNAVLIVGIPSDKETHKRKGLTVLSDVQRYETVRHCKWVDEVVEDAPWCVTMDFLEKHKIDYVAHDDLPYASGNDDDIYKPIKEKGMFLATQRTEGISTSDIITKIIRDYDKYLMRNFARGANRKDLNVSWLKKNELDFKRHVAEFRNSFKRKKVGKDLYGEIRGLLQNVLIWNGDNSGTSTPQRKTLQTNAKKMYMNVLKTLQAPDAVDVDSSENVSENVTDEEEEDDDEVDEDEEADDDDEDDEDEEDDE

SEQ ID NO: 226 - DNA, 13975 bp, Artificial Sequence
  Plasmid pZKSL-5S5A5
cgatggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggctctcagtcttaccacagaacagctgttagaacgccctgatttggttgcgattgatggcatcctctacgaccttgaagggcttgccaaagttcatccaggatccgatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaactctcctgcagcttcctcagcgagacactgctcctgtctggacccgagctaaggctctgttcgacaaacacgttctgcgaattggcgagtaatttcattaatgcaaatagacgtgtatttgaaaaggaggagatgatggtaccagtaatttacggtgtttgaatagacaaattatatatataaaattaacctgatgaatgagtgtatgaatggattgcttaatataccgagggagagccggcattatcaatatttattgtcctaagaagctaaaatatgctgttccgttgatagcgatgtctgtttgagagtcaatggcagaacgcggaggagtattgttagttggtgatcggtttactcgacatcgagtagggggcgagacagaagatatcccgaatccattgcattgtttattaggatgttcacaacacaactccctctagactctggggatgtgcgttagaagaatgacctggagcaagagtgttcagattgatccgttcaaattttcaagattactgttggggttgtttttgaatccacattagctggacgactattgcatctgagcgctcggaacgtctccctttcccttcagctttatacgagtcgattccataagcgcgacctctcgaattgccttcggttgtgaagccataggcaaaggtgtggctatggaatgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccgaggtttccaacgagataacatcgtggcagctgccaccatgaccgatatgcctgaaataagtgaattgaccatcagaagttctgcattcaaatagaactatatcatattcggctcagttttttcaataatagtccaatccctaagtctcctatccaaaatggttcctgaccagccacatccatgatcatgactgcgtgacaggaacagtcattccgtggatgaacgactttacgctcaggtactgtaaatatctgtaaagggcagacaaccaaccaattgagtaacctgtgagacttgaaacgtaagatgacttcacacacaaagtcacttgactcaaccgtggctctcaattgcacaaaatcactctgcactaatctattgcaggagtcaggctatgaacaactagacgacagctacttatgtgttatatagaggaatattaaaaaatctaagaataatcataaagttacaaaataattatcagatttcgagccacaggtcacccctaacatgtgttattgcacacccacaatcctcagcttgatgtcatttaattcttccagccaccatctctctctccaaccctaatggcaaactttattttggtggagcgatgactcttactcaactgcagcatacttaagcacaattgttccccagcctgatacgacacaccatccattgtcaagcttcaccacatacaacaacacagcgtacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcggatccgggatggaccttggcaagaccttccagatcgtagagaatgccgtcgatggcaaccaggtcgggtcgctcgagcagctgctcggtagtaagggagagagccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattggggctgttttttgggacacaaatacgccgccaacccggtctctcctgaattctgcagatgggctgcaggaattccgtcgtcgcctgagtcgactccaacttttcacactgagcgtaaaatgtggagaagaaatcggcactaaaaagtcaggtagactggaaaatgcgccatgaaatgaatatctcttgctacagtaatgcccagcatcgaggggtattgtgtcaccaacactatagtggcagctgaagcgctcgtgattgtagtatgagtctttattggtgatgggaagagttcactcaatattctcgttactgccaaaacaccacggtaatcggccagacaccatggatgtagatcaccaagcctgtgaatgttattcgagctaaaatgcacatggttggtgaaaggagtagttgctgtcgaattccgtcgtcgcctgagtcatcatttatttaccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaattcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatccccgctgatatgcctaaggaacaatcaaagaggaagatattaattcagaatgctagtatacagttagggat

SEQ ID NO: 227 - DNA, 14619 bp, Artificial Sequence
  Plasmid pZP2-85m98F
cgatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcacggatcccatgacggccagagagtcgtagtaggtagcgggaggaagtccggcaggtcgagcgggaccggcgccctgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtat

SEQ ID NO: 228 - DNA, 993 bp, Artificial Sequence
  993 bp stuffer fragment
ctctatccaatcacacagtcaactccgactaccacgctccggcgggcagtggagccttctactctcaccagaatggctctgagcgcgacatgccaccgcccgccacgtcctaccgaggataccagcctccgggatattgaaaaaaaagtgtaaatatttattatcgtcaatcgatcacgaattatctgaacggaatgaatgcagccgtgtgtgagctgtgtagatcatgtaacgtaaacggatacaatggctccatcctttcttgactcgtttccacttctgcaattgagtcgtaggaggtgatctcactcatgatcatgacttgtgcactaacgttggctctacagaatagtcagaatagtccagctcgtgccagtcgcgtgatttgaaacgcgaccaacaatgagaatgtttcataagctgcgctaagttggtgatgtctcacattcacattcgtttcatgacgcgatcaaacttgtctacagttacctattgcgaaacaaaactgcgggacagtttcttctatcatctataaatcattaatttatacaatccgtatccgacggattcgtttttcccattctttttgtctgcgtctccgtctaagcgagagaagtgaagaacttgtgggcgagctcgagcggccgcattctagatgcagacgcaccttgaccagatcaaacggatgaccaaccagaacggcgcagatacctccaaagccaccggcggcgaaggactcggcctgcgacaggaacgacttgagagcggaagggggagcgatggccttaacgccagagtcaatttcgggagcgtcactcattgtgtggggtgtgtggaagggatagttgagtgcagttaggagatggcaacgtccgagttataagaagtgtttagagttgttcacacgggaaggttacctcggcatgtgaatatggaggattcggtataggggggtgtagcggcgggtttagggggcgattgtgtatatatatg

SEQ ID NO: 229 - DNA, 7338 bp, Artificial Sequence
  Plasmid pYPS234
aaatgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaacgcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcatcaatcgatgactgtcgactcacgtacgggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagactagtctctatccaatcacacagtcaactccgactaccacgctccggcgggcagtggagccttctactctcaccagaatggctctgagcgcgacatgccaccgcccgccacgtcctaccgaggataccagcctccgggatattgaaaaaaaagtgtaaatatttattatcgtcaatcgatcacgaattatctgaacggaatgaatgcagccgtgtgtgagctgtgtagatcatgtaacgtaaacggatacaatggctccatcctttcttgactcgtttccacttctgcaattgagtcgtaggaggtgatctcactcatgatcatgacttgtgcactaacgttggctctacagaatagtcagaatagtccagctcgtgccagtcgcgtgatttgaaacgcgaccaacaatgagaatgtttcataagctgcgctaagttggtgatgtctcacattcacattcgtttcatgacgcgatcaaacttgtctacagttacctattgcgaaacaaaactgcgggacagtttcttctatcatctataaatcattaatttatacaatccgtatccgacggattcgtttttcccattctttttgtctgcgtctccgtctaagcgagagaagtgaagaacttgtgggcgagctcgagcggccgcattctagatgcagacgcaccttgaccagatcaaacggatgaccaaccagaacggcgcagatacctccaaagccaccggcggcgaaggactcggcctgcgacaggaacgacttgagagcggaagggggagcgatggccttaacgccagagtcaatttcgggagcgtcactcattgtgtggggtgtgtggaagggatagttgagtgcagttaggagatggcaacgtccgagttataagaagtgtttagagttgttcacacgggaaggttacctcggcatgtgaatatggaggattcggtataggggggtgtagcggcgggtttagggggcgattgtgtatatatatgggatcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgctgtgttgttgtatgtggtgaagcttgacaatggatggtgtgtcgtatcaggctggggaacaattgtgcttaagtatgctgcagttgagtaagagtcatcgctccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaaagatcttcgattt

SEQ ID NO: 230 - DNA, 1019 bp, Artificial Sequence
  1019 bp stuffer fragment
actcactctgtcagctgccccacattgcccaatgcacaatgcacaatgatgtgtgcaaacaacgcaatcaaaagtctatgcatgctgaccaaactctgatcaccaagttgcgaacatgaaaaagaagacctgtgtatatataagtaagggggagagccctaactagatctttcgaaaaccccccgaccttcaccttccacaaccatgatcatcttatacgttttggccgttgcggtctccttcctcatcttcaagagagtcacctacacgatgcgaagccgagagctcgccaagaagtggcactgtgaggagcctcacaacctgaatgatctagatagcggccgccatcttaacggtgtgttcgttaagatgacccgggacgaggctgcctttgccgagaccgagaagctcattaacgcataaagggatgtatacttgtactgtagatggattaataaattatttatgatgaacaaacattgactgagaaaggcaccatattgtagcttcaagtactgtactggtagaagtaagcctgtcgttacccacttatggagatccaatattgtttgatgcggccatcggactgcttggagcgtacagagaattggtaaaatgtggtggctgggttggtttcgattgaaattatcaagatctctgaggtattcttggtgttgaagggatgttcttggactactgcttgtaacatagatgggatgtagggatggcatggggtataatcgagacaaccattgtggaggtaggcaagagctcttacaagtaccatacgagtacaactactgaggcataatgtctggaattcccggttaagtccattacagttgatatcattcaaatcggacagatattctccgaggtgatacatctctgtccccgagagaagctgatttggagcacatccaggttacggggggagagaaatttatgtaatgtgaggattttttggagctgaataataaagtcctgttgatctagcttcaattgagtcaacatccgcc

SEQ ID NO: 231 - DNA, 7364 bp, Artificial Sequence
  Plasmid pYPS233
aaatgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaacgcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccacgcgtactcactctgtcagctgccccacattgcccaatgcacaatgcacaatgatgtgtgcaaacaacgcaatcaaaagtctatgcatgctgaccaaactctgatcaccaagttgcgaacatgaaaaagaagacctgtgtatatataagtaagggggagagccctaactagatctttcgaaaaccccccgaccttcaccttccacaaccatgatcatcttatacgttttggccgttgcggtctccttcctcatcttcaagagagtcacctacacgatgcgaagccgagagctcgccaagaagtggcactgtgaggagcctcacaacctgaatgatctagatagcggccgccatcttaacggtgtgttcgttaagatgacccgggacgaggctgcctttgccgagaccgagaagctcattaacgcataaagggatgtatacttgtactgtagatggattaataaattatttatgatgaacaaacattgactgagaaaggcaccatattgtagcttcaagtactgtactggtagaagtaagcctgtcgttacccacttatggagatccaatattgtttgatgcggccatcggactgcttggagcgtacagagaattggtaaaatgtggtggctgggttggtttcgattgaaattatcaagatctctgaggtattcttggtgttgaagggatgttcttggactactgcttgtaacatagatgggatgtagggatggcatggggtataatcgagacaaccattgtggaggtaggcaagagctcttacaagtaccatacgagtacaactactgaggcataatgtctggaattcccggttaagtccattacagttgatatcattcaaatcggacagatattctccgaggtgatacatctctgtccccgagagaagctgatttggagcacatccaggttacggggggagagaaatttatgtaatgtgaggattttttggagctgaataataaagtcctgttgatctagcttcaattgagtcaacatccgccgtcgactgacgtacgggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagactagttcagatctcgattt

SEQ ID NO: 232 - DNA, 9211 bp, Artificial Sequence
  Plasmid pYSP241
cgatgactgtcgactccaacttttcacactgagcgtaaaatgtggagaagaaatcggcactaaaaagtcaggtagactggaaaatgcgccatgaaatgaatatctcttgctacagtaatgcccagcatcgaggggtattgtgtcaccaacactatagtggcagctgaagcgctcgtgattgtagtatgagtctttattggtgatgggaagagttcactcaatattctcgttactgccaaaacaccacggtaatcggccagacaccatggatgtagatcaccaagcctgtgaatgttattcgagctaaaatgcacatggttggtgaaaggagtagttgctgtcgaattccgtcgtcgcctgagtcatcatttatttaccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaattcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgtttaaacggtaggttagtgcttggtatatgagttgtaggcatgacaatttggaaaggggtggactttgggaatattgtgggatttcaataccttagtttgtacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgcttaggccttgtctgccttggcaaccattcgagcgaaggtgcccaggtaggagataagaatgccgacaccttcgagcatgggaggagatcggtagggcaggttgtgcttcttgcacagctgctccactttgatggaggcagcggtgaggttgtgtctgggaagagtaggccacaggtgatgttcgatctggtagttgaggccaccgaaaaaccagtctgtgacgaggcctcgctgaacgttcatggtctcgtgaatctgtccagcacagaagccatgaccatcccacacggagtcctgaatcttctccagagggtagtggttcatgaagacaacgatggcaattccgaagccaccaagcagctcggagacaaagaacaccatgagtccggtgagaaacgagggcatgtagaaatagtagaacaaggccttgagaccccagtggagtgccagaccgacggactccttctcgtactgtcttcgatagtactgattgcttcgatccttgagacccgtggcagtatgaatggactgaaagcaccagatgaatcgcagaagggcacagatgaaaaagaagtaatactgttggtacttgatcatccgtcgagaaaacgggccagctcgctcgacgtcctccttggaccacgccaggagaggcaggttgtcgatgtcgggatcgtgaccctgcacgttggtggcggagtgatgagcgttgtgtcggtccttccaccaagtgacagaaaagccctgaagcacgtttccgaagagcaggccaatggcattgttgatggatcggtccttgaacagctggtgatggcaaatgtcgtgcgagagccatcccatctgttgaaagtgaatgccgaggacgatagcaccaaccaggtaccagtgccactgggtcatcaacagcacggcaaggacacccagtccgagagtcgacagggtcttgtaagcgtaccacatgggagaggcatcgaacatgcctgcagcaatgagctcgtctcgcagctttcggaaatcctcctgaggttcgtcggagtttggcttgggaggtgttggagtcaggggagaggaaggttccatgatgggcattcgtctgagtttggacacggcgttctcggagtgcataaccatgaagacgtcggtagcatcccgacctcggtagttctcgataatgtcggcacctccgggatggtggttgagccaggcagaaacgtcgtaggtgacaccgtccacggtgagaggcagagcgggtcgcttgaccatggttgatgtgtgtttaattcaagaatgaatatagagaagagaagaagaaaaaagattcaattgagccaaaccgatttaaatgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaacgcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccacttagtctacagattacgtgtggtgtactggtacctgtggtgtagcgacagtattgtacatactcgtactcccactctacacacccgccgccaccacttaccctcgtgagaaccccctcagaaactcacaaccgtcaccttagcagaagggtttagccgcttggagccgacagggatgtcaggcaatacagctgtcaccgaggggacaccggggtgtcaacaacagtgtcatttcggtgcttgtggagtgagtgacatcaccgagaaagttgtagtatgtaggggtttttggaatggttgtttcatgatccattggtactgctcggcaaaaatagcctgatggaatcacgtttcgttctggggttgacgggcatctcagctatctccatccacgagtgtctcagagataagacctgcatatctgttatctgttttcaaagtgtaagtcgtatagagtgccgggagggggtcaaggatgtgcatggacgtgactacagtgagagtttttggaggaagtaaagaccgagtatcgaccatccagaaaccccatatcttctggaattccacaaatggccaagactggcttcttttatccactttttgatactaaaaatgtctaatttgacctctcttccactaacaaaaacagtctcgccgttctccaacccgcaccaccaactacaagtacagtagctataattttttggcaccactcgcttttctctttttaggcgaaacttgtctcaaacttatcatgccataggcattaatttccgggtcttgcagagctactgcactggggggggggggtgtacaacgcacgaccgagtgctatgtaatgtacacaatggccacaaacacaactgttactgatgtaccgatgactcagcacctacagtagtccacgcgtttgacttccggggctcttcgggcccaatttttttcttcgtctgcttcccaaatgccagatttatgcaaggtgcatgtgacgtcccggtccgaggattgctataacgggcgaaataaggacacaaacaactcaaaaataataccaaaatatagcttgcaacaagggcttcagattgatcccattattggtccat

SEQ ID NO: 233 - DNA, 13926 bp, Artificial Sequence
  Plasmid pZR5AU-555
cgatccctaactgtatactagcattctgaattaatatcttcctctttgattgttccttaggcatatcagcggggatcccgtcaacagttttatatatcgtagttacaaccatcaacactttttggtaagtgtaccattctatactccaactggtctgcaactgtacaagtagacatgttaatggtagttaataacatctacagcagaacctatggtaaagacattgcatttttacaggaagtatcgtcctacacgttgataaatccaaagatgcggaacttcttccacttttatcatcatcccctactcgtacactcgtactctttgttcgatcgcgattcatttctataaataatcttgtatgtacatgcggccgcttagaactcctgggcatcctgaatggtgtgagcaacacccaccttctgcatgtatcgaagagtggacatgatgttctcgagaatggtaggatagtatgtgtaacggacgccatgtcgcttgcaacactcccgaacggtgtcttgaatgaagggatagtgccaagaggacattcggggaaacaagtgatgctcgatctgcaggttgagaccgcctgtaagcatcattcccacgctgccaccgtaggtggcagcagtctcggcctgtgctcggtaccagtcgactcgatcctcttccacgtctctgacctccttgccttccttagctcgtttggccttgcagttcttctctggggtccgttcggctccctcgaagttatgggacagaacgaacacaaaggtgaggaagatgcctgtgaccgtgggcaccagaagaatggtgagcagaggagaggcaccagcaatgtaccagggaagaaaggcgtttcggaagatgaagagcagtcgaagggaaacggcgaaagctcgctgccgattgaaaaagctgcctggtctgagagaagtggcctcgggaatggtgtcgttgtgctgcattgtgaagaggtacatgggattgtacaccatcgagacaccatacattcccagaacgatgtacatgtaccacgcctgaaatcggtggtaccactttcgagaggcgttggtagcaggataggagtggaacaagatgaacggctctgccgaggcagcatccaggtcgaggccatgctggttggtgtaagtgtgatgtcgcataatgtgggactgcagccagatccaacgagaggaaccaatggcgtcgatgccataagcgaaaaaggcgttgacccagggctttttgctgatggctccgtgagaaccatcgtgttgaatggccaagccaatctgcgagtggaagtatccagtaaagataccccacatcactgctccggttgtgatccagtaccactcgccaatggcagtacaagcgatgatgagtgcggttctcagccagaagccaggagtggcgtaccagtttcgacccttcatgacctctcgaacggactgcttgacgtcctgagcaaagggagagtcgaaggtgtacacgggatccttggagcttcgttcgtgcttgcctcgggcaaattgctgcagaagcttcgagttctctggcttgactccaggatgcatggagtagaacagagcggttccgtcggatgcaccggcagcttcgatgaggttgcctccggcatggaccttggccagaccgaagagatcgtacaggactccgtcgatggcaacgagctcggggtgttccaggagctgctcggtagtcagggagatggtggccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaagctaccaccacactcgttgggtgcagtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccaccgatggacttcctggaggcagaagaacttgttatggaaaagctcaagagagagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatggttctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgacagacggacaatgacgagccaggttcgcccaactgacggaatctcctatagtcttctcatcaagcgcataaatatagtatataaagaattacatggtgggccacagcttggcgatagtatgacggtctgggctccagatcacacccatgagggatgccgtgcgagtagatgtagaggtggtgcttccaggttgtccccaacaacaatcgctactggaaaataccgtgaaagtacgtacacccaactctgtgactcgcgttgactttcatctttcaatttggtcgtgtcttacggtgcatgtgctgtattggacatgaagaaggggttggcaagctgaaccatgcctgaggtgctggagtctgatactgtctagcagagggcgatcaaaagatcaccatccacacgtttgtttccatattcaatctccaatttccaacatctccttggctaatagccactttgagagatatttggtatcgcgtattcacttgtctcatatcccgtgtttctgtttcaccaaggcttggacgatattatcgcgagaaaaaccgtattgaggtatttattagagtcgagagaggaggaacaggtattcggaagatggaaaagctgtacagagcgagaaacgatcccatgtcgacgctcctgatggcttatactgagacatggaatcaggatcttgcccttcttcacagctctacttgcagctacagaattgctttttctcgtatccgatcataattccgctgctatgataggcagccaccgatacaatataggagagagtataggtattgactctatagacactgtatgatgctgacaaagctgactgagggattcgactcagcttcgccgttgcttgatctccaattaattatcgtaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattaccaacgttggcgcgccacaacgtcagaaactctcttccatccgataagccgtgtctaactatacgaccctcaaacaaggtcagccagaccaacttttagcactcgcaaaacacacacccaaacccaggccgcgacgcagccggagcccgtctacttatactgtttcgccgcagacgccaagtgacacaaaaagcgcacaaaccctcccccccagtggcggcgcacatccacaacaaacgacccataaacggcactcccacacggaaacaaaacgtttgtcgggttactcctcacgccaagacacactcacacacacaacctcccacctttcatcaccactcaactacgggtacagtagtggtagaaaacacagagtccagagtccacacagacaccgcacagagtctgtcacacaagcaccatgccaacaagcagaccgttcatttcgctgctgtttggaagcttctccacgtcgtatcaacgcaacaccaccacacagacctccgcatcgacagccaccgtcaccaccggccccacgtcgcagatgtacaagatgctcgacaaccactcgatacctgagcagccccagcagccgaccctgactcagacacagccagcggtgcagacggcgcagacggcgcagacggcgcagcaggcaagtgggactgcggacctcagcgaatcgccacacgacaagctgtggattggaggccgatcaaacgacggacgggaaaagttctaccggctggaaccggccaagcgaagggcatccttcgatcgcatttctctggatcaggtgtctatttgatgaggcgccaaacagtggccagaccaagtctggtatctcaacccctcaaaattgataaccaagtttctggtggagttcaaaccaaggggagctacggagccgttcacaaggtgtccacagaggttcaaagcacattgcaccaagaccgccatcatccttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttaggaatcctgtgcgtccttcacgcagtggacgacacccaccttatgcatgtacttcagggtggagatgatgttgccgacgatggtagggtagaaaacatatcgcactccatgtcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagatcgcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcctggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgacccgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaattgctgcaggagcttggagttctcgggcttgacgtagggatgcatagagtagaagaggggagaggcgtcggaggctccagaggccagaatgaggtctccaccaccatgcaccttggccaggccctcgaggtcgtacaggataccatcgatagcgacgagatcaggtcgctccaggagctgttcggtagtgagagacagggccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccat

SEQ ID NO: 234 - DNA, 13926 bp, Artificial Sequence
  Plasmid pZR5AU-555M
cgatccctaactgtatactagcattctgaattaatatcttcctctttgattgttccttaggcatatcagcggggatcccgtcaacagttttatatatcgtagttacaaccatcaacactttttggtaagtgtaccattctatactccaactggtctgcaactgtacaagtagacatgttaatggtagttaataacatctacagcagaacctatggtaaagacattgcatttttacaggaagtatcgtcctacacgttgataaatccaaagatgcggaacttcttccacttttatcatcatcccctactcgtacactcgtactctttgttcgatcgcgattcatttctataaataatcttgtatgtacatgcggccgcttagaactcctgggcatcctgaatggtgtgagcaacacccaccttctgcatgtatcgaagagtggacatgatgttctcgagaatggtaggatagtatgtgtaacggacgccatgtcgcttgcaacactcccgaacggtgtcttgaatgaagggatagtgccaagaggacattcggggaaacaagtgatgctcgatctgcaggttgagaccgcctgtaagcatcattcccacgctgccaccgtaggtggcagcagtctcggcctgtgctcggtaccagtcgactcgatcctcttccacgtctctgacctccttgccttccttagctcgtttggccttgcagttcttctctggggtccgttcggctccctcgaagttatgggacagaacgaacacaaaggtgaggaagatgcctgtgaccgtgggcaccagaagaatggtgagcagaggagaggcaccagcaatgtaccagggaagaaaggcgtttcggaagatgaagagcagtcgaagggaaacggcgaaagctcgctgccgattgaaaaagctgcctggtctgagagaagtggcctcgggaatggtgtcgttgtgctgcattgtgaagaggtacatgggattgtacaccatcgagacaccatacattcccagaacgatgtacatgtaccacgcctgaaatcggtggtaccactttcgagaggcgttggtagcaggataggagtggaacaagatgaacggctctgccgaggcagcatccaggtcgaggccatgctggttggtgtaagtgtgatgtcgcataatgtgggactgcagccagatccaacgagaggaaccaatggcgtcgatgccataagcgaaaaaggcgttgacccagggctttttgctgatggctccgtgagaaccatcgtgttgaatggccaagccaatctgcgagtggaagtatccagtaaagataccccacatcactgctccggttgtgatccagtaccactcgccaatggcagtacaagcgatgatgagtgcggttctcagccagaagccaggagtggcgtaccagtttcgacccttcatgacctctcgaacggactgcttgacgtcctgagcaaagggagagtcgaaggtgtacacgggatccttggagcttcgttcgtgcttgcctcgggcaaattgctgcagaagcttcgagttctctggcttgactccaggatgcatggagtagaacagagcggttccgtcggatgcaccggcagcttcgatgaggttgcctccggcatggaccttggccagaccgaagagatcgtacaggactccgtcgatggcaacgagctcggggtgttccaggagctgctcggtagtcagggagatggtggccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaagctaccaccacactcgttgggtgcagtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccaccgatggacttcctggaggcagaagaacttgttatggaaaagctcaagagagagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatggttctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgacagacggacaatgacgagccaggttcgcccaactgacggaatctcctatagtcttctcatcaagcgcataaatatagtatataaagaattacatggtgggccacagcttggcgatagtatgacggtctgggctccagatcacacccatgagggatgccgtgcgagtagatgtagaggtggtgcttccaggttgtccccaacaacaatcgctactggaaaataccgtgaaagtacgtacacccaactctgtgactcgcgttgactttcatctttcaatttggtcgtgtcttacggtgcatgtgctgtattggacatgaagaaggggttggcaagctgaaccatgcctgaggtgctggagtctgatactgtctagcagagggcgatcaaaagatcaccatccacacgtttgtttccatattcaatctccaatttccaacatctccttggctaatagccactttgagagatatttggtatcgcgtattcacttgtctcatatcccgtgtttctgtttcaccaaggcttggacgatattatcgcgagaaaaaccgtattgaggtatttattagagtcgagagaggaggaacaggtattcggaagatggaaaagctgtacagagcgagaaacgatcccatgtcgacgctcctgatggcttatactgagacatggaatcaggatcttgcccttcttcacagctctacttgcagctacagaattgctttttctcgtatccgatcataattccgctgctatgataggcagccaccgatacaatataggagagagtataggtattgactctatagacactgtatgatgctgacaaagctgactgagggattcgactcagcttcgccgttgcttgatctccaattaattatcgtaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattaccaacgttggcgcgccacaacgtcagaaactctcttccatccgataagccgtgtctaactatacgaccctcaaacaaggtcagccagaccaacttttagcactcgcaaaacacacacccaaacccaggccgcgacgcagccggagcccgtctacttatactgtttcgccgcagacgccaagtgacacaaaaagcgcacaaaccctcccccccagtggcggcgcacatccacaacaaacgacccataaacggcactcccacacggaaacaaaacgtttgtcgggttactcctcacgccaagacacactcacacacacaacctcccacctttcatcaccactcaactacgggtacagtagtggtagaaaacacagagtccagagtccacacagacaccgcacagagtctgtcacacaagcaccatgccaacaagcagaccgttcatttcgctgctgtttggaagcttctccacgtcgtatcaacgcaacaccaccacacagacctccgcatcgacagccaccgtcaccaccggccccacgtcgcagatgtacaagatgctcgacaaccactcgatacctgagcagccccagcagccgaccctgactcagacacagccagcggtgcagacggcgcagacggcgcagacggcgcagcaggcaagtgggactgcggacctcagcgaatcgccacacgacaagctgtggattggaggccgatcaaacgacggacgggaaaagttctaccggctggaaccggccaagcgaagggcatccttcgatcgcatttctctggatcaggtgtctatttgatgaggcgccaaacagtggccagaccaagtctggtatctcaacccctcaaaattgataaccaagtttctggtggagttcaaaccaaggggagctacggagccgttcacaaggtgtccacagaggttcaaagcacattgcaccaagaccgccatcatccttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttaggaatcctgtgcgtccttcacgcagtggacgacacccaccttatgcatgtacttcagggtggagatgatgttgccgacgatggtagggtagaaaacatatcgcactccatgtcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagagctcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcctggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgacccgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaattgctgcaggagcttggagttctcgggcttgacgtagggatgcatagagtagaagaggggagaggcgtcggaggctccagaggccagaatgaggtctccaccaccatgcaccttggccaggccctcgaggtcgtacaggataccatcgatagcgacgagatcaggtcgctccaggagctgttcggtagtgagagacagggccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccat

SEQ ID NO: 235 - protein, 5 aa, Artificial Sequence
  HDGNH motif
HDGNH

SEQ ID NO: 236 - protein, 5 aa, Artificial Sequence
  HDANH motif
HDANH

SEQ ID NO: 237 - protein, 5 aa, Artificial Sequence
  HEFAH motif
HEFAH

SEQ ID NO: 238 - protein, 5 aa, Artificial Sequence
  HEFTH motif
HEFTH

SEQ ID NO: 239 - protein, 5 aa, Artificial Sequence
  HEMGH motif
HEMGH

SEQ ID NO: 240 - protein, 5 aa, Artificial Sequence
  HEAGH motif
HEAGH

SEQ ID NO: 241 - protein, 5 aa, Artificial sequence
  HDFGH motif
HDFGH

SEQ ID NO: 242 - protein, 5 aa, Artificial Sequence
  HDYGH motif
HDYGH

SEQ ID NO: 243 - protein, 5 aa, Artificial Sequence
  HDSCH motif
HDSCH

SEQ ID NO: 244 - protein, 5 aa, Artificial Sequence
  HDACH motif
HDACH

SEQ ID NO: 245 - DNA, 24 bp, Artificial Sequence
  Primer EgD5-5
ctcaaacattctctccattggtcc

SEQ ID NO: 246 - DNA, 35 bp, Artificial Sequence
  Primer EgD5 M1-3
gaatcaaatctcctcctccatgaactttggcaagc

SEQ ID NO: 247 - DNA, 35 bp, Artificial Sequence
  Primer EgD5 M1-5
gcttgccaaagttcatggaggaggagatttgattc

SEQ ID NO: 248 - DNA, 26 bp, Artificial Sequence
  Primer EgD5-3
tattctgtttccgccaaaggtacatg

SEQ ID NO: 249 - DNA, 1347 bp, Euglena gracilis
  CDS (1)..(1347)
atggctctcagtcttaccacagaacagctgttagaacgccctgatttggttgcgattgatggcatcctctacgaccttgaagggcttgccaaagttcatggaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcc

SEQ ID NO: 250 - protein, 449 aa, Euglena gracilis
MALSLTTEQLLERPDLVAIDGILYDLEGLAKVHGGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 251 - DNA, 38 bp, Artificial Sequence
  Primer EgD5 M2-3
cttgctgatggccccgtggcccgcatcatgctggatgg

SEQ ID NO: 252 - DNA, 38 bp, Artificial Sequence
  Primer EgD5 M2-5
ccatccagcatgatgcgggccacggggccatcagcaag

SEQ ID NO: 253 - DNA, 5050 bp, Artificial Sequence
  Plasmid pLF336
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggctcaaacattctctccattggtccttaaacactcatcagtcatcaccgcggccgcaaaccatggctctcagtcttaccacagaacagctgttagaacgccctgatttggttgcgattgatggcatcctctacgaccttgaagggcttgccaaagttcatggaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaagcggccgcatttcgcaccaaatcaatgaaagtaataatgaaaagtctgaataagaatacttaggcttagatgcctttgttacttgtgtaaaataacttgagtcatgtacctttggcggaaacagaata

SEQ ID NO: 254 - DNA, 1347 bp, Euglena gracilis
  CDS (1)..(1347)
atggctctcagtcttaccacagaacagctgttagaacgccctgatttggttgcgattgatggcatcctctacgaccttgaagggcttgccaaagttcatggaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcc

SEQ ID NO: 255 - protein, 449 aa, Euglena gracilis; identical to SEQ ID NO: 143

SEQ ID NO: 256 - DNA, 38 bp, Artificial Sequence
  Primer EgD5 M3-3
cttgctgatggccccgtgggccgcatcatgctggatgg

SEQ ID NO: 257 - DNA, 38 bp, Artificial Sequence
  Primer EgD5 M3-5
ccatccagcatgatgcggcccacggggccatcagcaag

SEQ ID NO: 258 - DNA, 5050 bp, Artificial Sequence
  Plasmid pLF337
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggctcaaacattctctccattggtccttaaacactcatcagtcatcaccgcggccgcaaaccatggctctcagtcttaccacagaacagctgttagaacgccctgatttggttgcgattgatggcatcctctacgaccttgaagggcttgccaaagttcatggaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcggcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaagcggccgcatttcgcaccaaatcaatgaaagtaataatgaaaagtctgaataagaatacttaggcttagatgcctttgttacttgtgtaaaataacttgagtcatgtacctttggcggaaacagaata

SEQ ID NO: 259 - DNA, 1347 bp, Euglena gracilis
  CDS (1)..(1347)
atggctctcagtcttaccacagaacagctgttagaacgccctgatttggttgcgattgatggcatcctctacgaccttgaagggcttgccaaagttcatggaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcggcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcc

SEQ ID NO: 260 - protein, 449 aa, Euglena gracilis; identical to SEQ ID NO: 141

SEQ ID NO: 261 - DNA, 21 bp, Artificial Sequence
  Primer EaD5-5
tgtaatacgactcactatagg

SEQ ID NO: 262 - DNA, 37 bp, Artificial Sequence
  Primer EaD5 M1-3
caatgaggttgccacctccatgcactttcgccagtcc

SEQ ID NO: 263 - DNA, 37 bp, Artificial Sequence
  Primer EaD5 M1-5
ggactggcgaaagtgcatggaggtggcaacctcattg

SEQ ID NO: 264 - DNA, 21 bp, Artificial Sequence
  Primer EaD5-3
gccagtgtgctggaattcagg

SEQ ID NO: 265 - DNA, 1362 bp, Euglena anabaena
  CDS (1)..(1362)
atggccaccatctctttgactactgagcaacttttagaacacccagaactggttgcaattgatggggtgttgtacgatctcttcggactggcgaaagtgcatggaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattc

SEQ ID NO: 266 - protein, 454 aa, Euglena anabaena
MATISLTTEQLLEHPELVAIDGVLYDLFGLAKVHGGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 267 - DNA, 35 bp, Artificial Sequence
  Primer EaD5 M2-3
gctgatggctccgtgaccggcatcgtgttgaatcg

SEQ ID NO: 268 - DNA, 35 bp, Artificial Sequence
  Primer EaD5 M2-5
cgattcaacacgatgccggtcacggagccatcagc

SEQ ID NO: 269 - DNA, 5007 bp, Artificial Sequence
  Plasmid pLF338
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggtgtaatacgactcactatagggcgaattgggccctctagatgcatgctcgagcggccgccagtgtgatggatatctgcagaattcaggagcggccgcaccatggccaccatctctttgactactgagcaacttttagaacacccagaactggttgcaattgatggggtgttgtacgatctcttcggactggcgaaagtgcatggaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgccggtcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagcggccgcacctgaattccagcacactggc

SEQ ID NO: 270 - DNA, 1362 bp, Euglena anabaena
  CDS (1)..(1362)
atggccaccatctctttgactactgagcaacttttagaacacccagaactggttgcaattgatggggtgttgtacgatctcttcggactggcgaaagtgcatggaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgccggtcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattc

SEQ ID NO: 271 - protein, 454 aa, Euglena anabaena
MATISLTTEQLLEHPELVAIDGVLYDLFGLAKVHGGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDAGHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 272 - DNA, 35 bp, Artificial Sequence
  Primer EaD5 M3-3
gctgatggctccgtgagcggcatcgtgttgaatcg

SEQ ID NO: 273 - DNA, 35 bp, Artificial Sequence
  Primer EaD5 M3-5
cgattcaacacgatgccgctcacggagccatcagc

SEQ ID NO: 274 - DNA, 5007 bp, Artificial Sequence
  Plasmid pLF339
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggtgtaatacgactcactatagggcgaattgggccctctagatgcatgctcgagcggccgccagtgtgatggatatctgcagaattcaggagcggccgcaccatggccaccatctctttgactactgagcaacttttagaacacccagaactggttgcaattgatggggtgttgtacgatctcttcggactggcgaaagtgcatggaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgccgctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagcggccgcacctgaattccagcacactggc

SEQ ID NO: 275 - DNA, 1362 bp, Euglena anabaena
  CDS (1)..(1362)
atggccaccatctctttgactactgagcaacttttagaacacccagaactggttgcaattgatggggtgttgtacgatctcttcggactggcgaaagtgcatggaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgccgctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattc

SEQ ID NO: 276 - protein, 454 aa, Euglena anabaena
MATISLTTEQLLEHPELVAIDGVLYDLFGLAKVHGGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDAAHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 277 - protein, 5 aa, Artificial Sequence
  HDcSH motif
HDCSH

SEQ ID NO: 278 - protein, 5 aa, Artificial Sequence
  HDdSH motif
HDDSH

SEQ ID NO: 279 - protein, 5 aa, Artificial Sequence
  HDeSH motif
HDESH

SEQ ID NO: 280 - protein, 5 aa, Artificial Sequence
  HDfSH motif
HDFSH

SEQ ID NO: 281 - protein, 5 aa, Artificial Sequence
  HDhSH motif
HDHSH

SEQ ID NO: 282 - protein, 5 aa, Artificial Sequence
  HDiSH motif
HDISH

SEQ ID NO: 283 - protein, 5 aa, Artificial Sequence
  HDkSH motif
HDKSH

SEQ ID NO: 284 - protein, 5 aa, Artificial Sequence
  HDlSH motif
HDLSH

SEQ ID NO: 285 - protein, 5 aa, Artificial Sequence
  HDmSH motif
HDMSH

SEQ ID NO: 286 - protein, 5 aa, Artificial Sequence
  HDnSH motif
HDNSH

SEQ ID NO: 287 - protein, 5 aa, Artificial Sequence
  HDpSH motif
HDPSH

SEQ ID NO: 288 - protein, 5 aa, Artificial Sequence
  HDqSH motif
HDQSH

SEQ ID NO: 289 - protein, 5 aa, Artificial Sequence
  HDrSH motif
HDRSH

SEQ ID NO: 290 - protein, 5 aa, Artificial Sequence
  HDtSH motif
HDTSH

SEQ ID NO: 291 - protein, 5 aa, Artificial Sequence
  HDvSH motif
HDVSH

SEQ ID NO: 292 - protein, 5 aa, Artificial Sequence
  HDwSH motif
HDWSH

SEQ ID NO: 293 - protein, 5 aa, Artificial Sequence
  HDySH motif
HDYSH

SEQ ID NO: 294 - protein, 5 aa, Artificial Sequence
  HDAcH motif
HDACH

SEQ ID NO: 295 - protein, 6 aa, Artificial Sequence
  HDAdH motif
VHDADH

SEQ ID NO: 296 - protein, 5 aa, Artificial Sequence
  HDAeH motif
HDAEH

SEQ ID NO: 297 - protein, 5 aa, Artificial Sequence
  HDAfH motif
HDAFH

SEQ ID NO: 298 - protein, 5 aa, Artificial Sequence
  HDAhH motif
HDAHH

SEQ ID NO: 299 - protein, 5 aa, Artificial Sequence
  HDAiH motif
HDAIH

SEQ ID NO: 300 - protein, 5 aa, Artificial Sequence
  HDAkH motif
HDAKH

SEQ ID NO: 301 - protein, 5 aa, Artificial Sequence
  HDAlH motif
HDALH

SEQ ID NO: 302 - protein, 5 aa, Artificial Sequence
  HDAmH motif
HDAMH

SEQ ID NO: 303 - protein, 5 aa, Artificial Sequence
  HDAnH motif
HDANH

SEQ ID NO: 304 - protein, 5 aa, Artificial Sequence
  HDApH motif
HDAPH

SEQ ID NO: 305 - protein, 5 aa, Artificial Sequence
  HDAqH motif
HDAQH

SEQ ID NO: 306 - protein, 5 aa, Artificial Sequence
  HDArH motif
HDARH

SEQ ID NO: 307 - protein, 5 aa, Artificial Sequence
  HDAtH motif
HDATH

SEQ ID NO: 308 - protein, 5 aa, Artificial Sequence
  HDAvH motif
HDAVH

SEQ ID NO: 309 - protein, 5 aa, Artificial Sequence
  HDAwH motif
HDAWH

SEQ ID NO: 310 - protein, 5 aa, Artificial Sequence
  HDAyH motif
HDAYH

SEQ ID NO: 311 - protein, 5 aa, Artificial Sequence
  HDxxH motif
  misc_feature (3)..(4): Xaa can be any naturally occurring amino acid
HDXXH

What is claimed is:

1. An isolated nucleic acid molecule encoding a mutant polypeptide having delta-5 desaturase activity comprising:
    (a) an amino acid motif as set forth in SEQ ID NO:11 (HPGs); and
    (b) an amino acid motif as set forth in SEQ ID NO:18 (HDAgH).

2. The isolated nucleic acid molecule of claim 1, wherein said mutant polypeptide has at least 90% sequence identity based on a BLASTP method of alignment when compared to a polypeptide having a sequence selected from the group consisting of: SEQ ID NO:21, SEQ ID NO:25 and SEQ ID NO:29.

3. The isolated nucleic acid molecule of claim 2, wherein the mutant polypeptide has the amino acid sequence as set forth in SEQ ID NO:187.

4. The isolated nucleic acid molecule of any one of claims 1, 2, or 3, wherein the mutant polypeptide has a dihomo-gamma-linolenic acid to arachidonic acid conversion efficiency that is at least 64% of the dihomo-gamma-linolenic acid to arachidonic acid conversion efficiency of the parent polypeptide of the mutant polypeptide, said parent polypeptide comprising an amino acid motif identical to SEQ ID NO:7 [HPGG] and an amino acid motif identical to SEQ ID NO:8 [H DASH].

5. The isolated nucleic acid molecule of claim 3 having the nucleotide sequence as set forth in SEQ ID NO:186.

6. A transformed host cell comprising the isolated nucleic acid molecule of claim 1.

7. The transformed host cell of claim 6 selected from the group consisting of microbes and plants.

8. The transformed host cell of claim 7, wherein the microbial host cell is an oleaginous yeast.

9. The transformed host cell of claim 8, wherein the oleaginous yeast is *Yarrowia lipolytica*.

10. The transformed host cell of either of claims 6 or 9, wherein the host cell produces a polyunsaturated fatty acid selected from the group consisting of omega-6 fatty acids and omega-3 fatty acids.

11. The transformed host cell of claim 7, wherein the host cell is a plant host cell, and wherein the plant host cell is an oilseed plant cell.

* * * * *